US012565516B2

(12) United States Patent
Huang

(10) Patent No.: US 12,565,516 B2
(45) Date of Patent: Mar. 3, 2026

(54) CARRIER PROTEIN FOR IMPROVING PROPERTIES OF BIOACTIVE PROTEIN

(71) Applicant: ZHEJIANG DOER BIOLOGICS CORPORATION, Hangzhou (CN)

(72) Inventor: Yanshan Huang, Hangzhou (CN)

(73) Assignee: ZHEJIANG DOER BIOLOGICS CORPORATION, Hangzhou (CN)

( * ) Notice: Subject to any disclaimer, the term of this patent is extended or adjusted under 35 U.S.C. 154(b) by 1300 days.

(21) Appl. No.: 17/284,608

(22) PCT Filed: Sep. 27, 2019

(86) PCT No.: PCT/CN2019/108430
§ 371 (c)(1),
(2) Date: Nov. 29, 2021

(87) PCT Pub. No.: WO2020/073825
PCT Pub. Date: Apr. 16, 2020

(65) Prior Publication Data
US 2022/0073563 A1     Mar. 10, 2022

(30) Foreign Application Priority Data

Oct. 12, 2018    (CN) .......................... 201811190459.7

(51) Int. Cl.
| | |
|---|---|
| *A61K 38/00* | (2006.01) |
| *C07K 7/08* | (2006.01) |
| *C07K 14/00* | (2006.01) |
| *C07K 14/535* | (2006.01) |
| *C07K 14/61* | (2006.01) |
| *C12N 9/80* | (2006.01) |

(52) U.S. Cl.
CPC ................ *C07K 7/08* (2013.01); *C07K 14/00* (2013.01); *C07K 14/535* (2013.01); *C07K 14/61* (2013.01); *C12N 9/80* (2013.01); *C12Y 305/03001* (2013.01); *C07K 2319/31* (2013.01); *C07K 2319/35* (2013.01)

(58) Field of Classification Search
CPC ........ A61K 47/42; A61K 47/64; C07K 14/00; C07K 14/535; C07K 14/61; C07K 2319/00; C07K 2319/31; C07K 2319/35; C07K 7/08; C07K 14/495; C07K 14/515; C07K 14/605; C07K 14/78; C07K 2319/02; C07K 2319/21; C12N 9/80; C12N 15/11; C12N 9/78; C12Y 305/03001
See application file for complete search history.

(56) References Cited

U.S. PATENT DOCUMENTS

2010/0119598 A1 *  5/2010  Yoshinari ............. A61K 31/232
                                                                    424/456

FOREIGN PATENT DOCUMENTS

| CN | 1011970678 A | | 2/2011 | |
|---|---|---|---|---|
| CN | 103641896 A | * | 3/2014 | ........... C07K 14/505 |
| EP | 1014176 B1 | * | 4/2009 | ............. C07K 14/78 |

OTHER PUBLICATIONS

Translation of CN103641896A provided by Espacenet (Year: 2014).*

* cited by examiner

*Primary Examiner* — Lianko G Garyu
*Assistant Examiner* — Mercy H Sabila
(74) *Attorney, Agent, or Firm* — IPRTOP LLC

(57) ABSTRACT

The present disclosure provides a carrier protein for improving properties of a bioactive protein. The carrier protein has a G-X-Y ternary repetitive structure, G is glycine, and X and Y are independently selected from proline, alanine and glutamic acid. The present disclosure further provides a fusion protein containing the carrier protein and the bioactive protein. The fusion protein of the present disclosure has improved biological properties, such as improved pharmacokinetic and physicochemical properties.

14 Claims, 6 Drawing Sheets
Specification includes a Sequence Listing.

CARRIER PROTEIN FOR IMPROVING PROPERTIES OF BIOACTIVE PROTEIN

CROSS REFERENCE TO RELATED PATENT APPLICATION

The present application is the US national stage of PCT/CN2019/108430 filed on 2019 Sep. 27, which claims the priority of the Chinese patent application No. 201811190459.7 filed on 2018 Oct. 12, which application is incorporated herein by reference.

TECHNICAL FIELD

The present disclosure relates to the field of biotechnology, and in particular, to a carrier protein that is capable of improving the properties of an active protein.

BACKGROUND

It is well known that proteins or polypeptides with a molecular weight less than 70 kDa are easily eliminated by the body through kidney filtration (Jevsevar S, Kunstelj M, Porekar V G, PEGylation of therapeutic proteins, Biotechnol J., 5:113-28, 2010). Therefore, the proteins or polypeptides are generally fused or cross-linked with carrier proteins with large molecular weights, polyethylene glycol (PEG), fatty acids, etc. to increase the apparent molecular weight and hydrodynamic radius, thereby reducing the glomerular filtration rate (Kontermann R E, Strategies to extend plasma half-lives of recombinant antibodies, BioDrugs, 23:93-109; 2009; Kang J S et al., Emerging PEGylated drugs. Expert Opin Emerg Drugs., 14:363-80, 2009), and finally extending the in-vivo half-life of the protein or polypeptide.

The carrier used for cross-linking is generally PEG or fatty acid, etc. Human serum albumin, immunoglobulin Fc fragment and transferrin are commonly used for recombinant fusion, and most of them have corresponding successfully marketed drugs. In recent years, new types of carrier proteins for recombinant fusion have continued to emerge (WR Strohl, Fusion Proteins for Half-Life Extension of Biologics as a Strategy to Make Biobetters, Biodrugs, 2015, 29(4): 215-39), such as URP (Chinese Patent ZL200780015899.2), XTEN (Chinese patent application CN201080011467.6; Volker Schellenberger et al., A recombinant polypeptide extends the in vivo half-life of peptides and proteins in a tunable manner. Nature Biotechnology 27(12):1186, 2009), elastin-like protein ELP (MacEwan S R, Chilkoti A., Applications of elastin-like polypeptides in drug delivery. J Control Release. 2014; 190:314-30.), PAS (Patent No. ZL200880019017, M Schlapschy, etc., PASylation: a biological alternative to PEGylation for extending the plasma half-life of pharmaceutically active proteins. Protein Engineering Design&Selection Peds. 2013, 26(8): 489-501) and GLK (Chinese Patent No. 200980103870.9). Protein drugs prepared by fusion of XTEN and ELP are already applied in clinical trials (Yuen K C, etc., A long-acting human growth hormone with delayed clearance (VRS-317): results of a double-blind, placebo-controlled, single ascending dose study in growth hormone-deficient adults, J Clin Endocrinol Metab., 98(6):2595-603.2013; Christiansen M et al., Weekly Subcutaneous Doses of Glymera (PB1023) a Novel GLP-1 Analogue Reduce Glucose Exposure Dose Dependently). These artificially designed non-natural proteins are recombinantly expressed or cross-linked with certain active proteins or peptides to form fusion proteins or products. Compared with the active proteins and peptides alone, the above fusion proteins or products significantly improve the serum stability and prolong the in-vivo half-life, and ultimately improve the therapeutic effect.

Chinese Patent ZL200780015899.2 discloses an unstructured recombinant polymer (URP), which is substantially incapable of non-specifically binding to a serum protein, and is characterized in that: (a) the URP includes at least 100 contiguous amino acids; (b) the sum of glycine (G), aspartate (D), alanine (A), serine(S), threonine (T), glutamate (E) and proline (P) residues contained in the URP constitutes more than about 80% of the total amino acids of the URP; (c) at least 50% of the amino acids in the URP sequence are devoid of secondary structure as determined by Chou-Fasman algorithm; (d) the URP has a Tepitope score less than −4.

Chinese patent application CN201080011467.6 discloses an isolated extended recombinant polypeptide (XTEN) including greater than about 400 to about 3000 amino acid residues, and the XTEN is characterized in that: (a) the sum of glycine (G), alanine (A), serine(S), threonine (T), glutamate (E) and proline (P) residues constitutes more than about 80% of the total amino acid sequence of the XTEN; (b) the XTEN sequence is substantially non-repetitive; (c) the XTEN sequence lacks a predicted T-cell epitope when analyzed by TEPITOPE algorithm, and the TEPITOPE algorithm prediction for epitopes within the XTEN sequence is based on a score of −9 or greater; (d) the XTEN sequence has greater than 90% random coil formation as determined by GOR algorithm; and (e) the XTEN sequence has less than 2% alpha helices and less than 2% beta-sheets as determined by Chou-Fasman algorithm.

Chinese Patent ZL200880019017 discloses a biologically active protein including at least two domains, and the biologically active protein is characterized in that: (a) a first domain of the at least two domains includes an amino acid sequence having and/or mediating the biological activity; and (b) a second domain of the at least two domains includes an amino acid sequence consisting of at least about 10 amino acid residues forming random coil conformation, and the random coil conformation mediates an increased in-vivo and/or in-vitro stability of the biologically active protein.

Elastin-like protein ELP is composed of (VPGXG)n, where X may be any amino acid except proline (Pro). The number of n is not fixed. ELP has a characteristic that its state will undergo a sharp transition at a specific temperature (span of 2-3° C.): below this temperature, the ELP is soluble; above this temperature, the ELP will quickly aggregate into micron-sized particles visible to the naked eye; when the temperature is lowered again, the ELP will be dissolved again; this temperature is called the reverse phase transition temperature, or phase-transition temperature (Tt). ELP belongs to elastin, which is biodegradable and non-immunogenic. Therefore, ELP is suitable for use as a fusion protein to extend the half-life of drugs.

Chinese patent ZL200980103870.9 discloses a recombinant gelatin-like unit (GLK) for prolonging the in-vivo half-life of proteins, which is characterized in that the gelatin-like unit is a polypeptide having the following structure: (Gly-X-Y)n; Gly is a glycine residue; X and Y are residues of any amino acid except Cys in 20 natural amino acids, and Hyp, respectively; n is 20-300; and the gelatin-like unit has the following characteristics: (a) in the gelatin-like unit, the sum of percentage contents of the following hydrophilic amino acids, Asn, Asp, Gln, Glu, Lys, Pro, Ser, Hyp and Arg, is 40% to ⅔; (b) in the gelatin-like unit, the ratio of the sum of the numbers of Pro and Hyp to n is greater than or equal to 0.6; (c) the ratio of the sum of the numbers of Gly to n is less than or equal to 1.15; and the GRAVY value representing hydrophilicity is less than −1.1 according to ProtParam formula; the additional condition is that the gelatin-like unit is not a natural gelatin protein.

The above-mentioned several new carrier proteins differ from the traditional albumin and immunoglobulin IgG FC fragments in that most sequences of the new carrier proteins have fewer types of amino acids, and are generally composed of only a few specific types of amino acids. In the VPGXG component unit of the elastin-like protein ELP, there is no strict restriction on the charge or hydrophilicity of the amino acid at the X position. The design of URP and XTEN emphasizes the use of hydrophilic amino acids, and the addition of negatively charged aspartic acid and/or glutamic acid to further extend the half-life. This is due to the fact that most tissues and surfaces of humans or animals have a net negative charge, the XTEN sequence can be designed to have a net negative charge to minimize non-specific interactions between the XTEN-containing composition and various surfaces such as blood vessels, healthy tissues or various receptors (Chinese patent application, CN201080011467.6); in contrast, PAS focuses on imitating polyethylene glycol (PEG), using three uncharged amino acids: proline, alanine and serine. On the other hand, the XTEN sequence emphasizes the feature of "essentially non-repetitive": "repetitive amino acid sequences tend to aggregate to form higher-order structures (such as natural repetitive sequences including collagen and leucine zippers), or to form contacts which result in crystalline or quasi-crystalline structures; on the contrary, the low tendency of non-repetitive sequences to aggregate allows the design of long XTEN sequences with relatively low frequency of charged amino acids, which may aggregate if the sequence is repeated". The XTEN technique interprets "substantially non-repetitive" as "a lack or limited degree of internal homology within a peptide or polypeptide sequence. For example, few or none of the four contiguous amino acids of the sequence are the same amino acid type, or, the polypeptide has a subsequence score of 10 or lower, or, there is no pattern of motif constituting the polypeptide sequence in the sequence from N-terminal to C-terminal".

The fusion or cross-linking of active proteins or polypeptides with these carrier proteins may significantly reduce their biological activities. For example, Gething N C et al. reported that the glucagon-XTEN fusion protein exhibited only 15% of the bioactivity of the unmodified glucagon polypeptide (Gething N C et al., Gcg-XTEN: an improved glucagon capable of preventing hypoglycemia without increasing baseline blood glucose, PLOS One, 2010, 5(4): e10175). However, the improvement of physicochemical properties such as stability and solubility after fusion or cross-linking can compensate up for this defect.

SUMMARY

The present disclosure provides a gelatin-like unit with the following repetitive structure:

(G-X-Y)n

G is glycine, and X and Y are independently selected from proline, alanine and glutamic acid; n is an integer of 5-20, preferably, n is an integer of 6-20 or 9-15. An exemplary gelatin-like unit may be selected from the gelatin-like unit shown in any odd-numbered sequence in SEQ ID NO: 17-89. Preferably, the gelatin-like unit is selected from the group consisting of SEQ ID NO: 17, SEQ ID NO: 19, SEQ ID NO: 21, SEQ ID NO: 25, SEQ ID NO: 27, SEQ ID NO: 29 and SEQ ID NO: 31.

The present disclosure further provides a gelatin-like protein, which contains at least two gelatin-like units described herein; the at least two gelatin-like units may be the same or different. Preferably, the content of alanine in the gelatin-like protein is greater than or equal to 10%, preferably greater than or equal to 12%, more preferably greater than or equal to 15%, more preferably greater than or equal to 18%, more preferably greater than or equal to 20%. Preferably, the content of alanine in the gelatin-like protein is less than or equal to 45%, such as less than or equal to 40% or less than or equal to 35%. Preferably, in the gelatin-like unit, the GRAVY value representing hydrophilicity is greater than −1.1, preferably greater than or equal to −1.0, more preferably greater than or equal to −0.9, more preferably greater than or equal to −0.8. Preferably, the GRAVY value is less than or equal to 0, such as less than or equal to −0.1 or less than or equal to −0.2. Preferably, the gelatin-like protein includes 100-2000 amino acids. An exemplary gelatin-like protein may be selected from a sequence shown in any odd-numbered sequence in SEQ ID NO: 91-185, or may include two or more (such as 2-20) sequences shown in any odd-numbered sequence in SEQ ID NO: 91-185. An exemplary gelatin-like protein including two or more sequences shown in any odd-numbered sequence in SEQ ID NO: 91-185 is preferably a tandem repeat sequence of two or more identical sequences, including but not limited to the sequence of amino acid residues 1-231 of SEQ ID NO: 231, the sequence of amino acid residues 1-573 of SEQ ID NO: 239, the sequence of amino acid residues 1-915 of SEQ ID NO: 263, the sequence of amino acid residues 1-864 of SEQ ID NO: 265, the sequence of amino acid residues 1-864 of SEQ ID NO: 267, the sequence of amino acid residues 1-864 of SEQ ID NO: 269, the sequence of amino acid residues 1-864 of SEQ ID NO: 271, the sequence of amino acid residues 1-864 of SEQ ID NO: 273, the sequence of amino acid residues 1-915 of SEQ ID NO: 275, the sequence of amino acid residues 1-216 of SEQ ID NO: 279, the sequence of amino acid residues 1-216 of SEQ ID NO: 281, the sequence of amino acid residues 1-231 of SEQ ID NO: 283, the sequence of amino acid residues 1-687 of SEQ ID NO: 293, the sequence of amino acid residues 1-648 of SEQ ID NO: 295, the sequence of amino acid residues 1-648 of SEQ ID NO: 297, the sequence of amino acid residues 1-687 of SEQ ID NO: 299, the sequence of amino acid residues 34-948 of SEQ ID NO: 303, the sequence of amino acid residues 34-948 of SEQ ID NO: 305, and the sequence of amino acid residues 1-1029 of SEQ ID NO: 309. Preferably, the gelatin-like protein includes an amino acid sequence having an identity percentage of at least 80%, more preferably at least 85%, more preferably at least 90%, more preferably at least 95% with any of the amino acid sequences described in this paragraph.

The present disclosure further provides a fusion protein, which contains the gelatin-like protein of the present disclosure and a bioactive protein. An exemplary fusion protein may be selected from the fusion proteins shown in any odd-numbered sequence in SEQ ID NO: 211-239, 247-259 and 263-309.

The present disclosure further provides a polynucleotide sequence selected from:

(1) a polynucleotide sequence encoding the gelatin-like unit, the gelatin-like protein or the fusion protein described herein; and (2) the complementary sequence of the polynucleotide sequence described in (1).

The present disclosure further provides a nucleic acid construct containing the polynucleotide sequence described herein. Preferably, the nucleic acid construct is a cloning vector or an expression vector.

The present disclosure further provides a host cell, the host cell:

(1) contains the polynucleotide sequence and/or the nucleic acid construct described herein; and (2) expresses the gelatin-like unit, the gelatin-like protein and/or the fusion protein described herein.

The present disclosure further provides the use selected from:

(1) the use of the gelatin-like unit described herein, the coding sequence of the gelatin-like unit, or the complementary sequence of the coding sequence in the preparation of a gelatin-like protein or a fusion protein containing the gelatin-like protein;

(2) the use of the gelatin-like protein described herein, the coding sequence of the gelatin-like protein, or the complementary sequence of the coding sequence in the preparation of a fusion protein containing the gelatin-like protein, or in improving the pharmacokinetics of a bioactive protein and/or enhancing the physicochemical properties of the bioactive protein; and (3) the use of the fusion protein described herein, the coding sequence of the fusion protein, or the nucleic acid construct containing the coding sequence or the complementary sequence of the coding sequence in the preparation of a medicament.

The present disclosure further provides a method for preparing a carrier protein capable of improving biological properties or biological functions of a bioactive protein, including preparing the carrier protein by a chemical synthesis method or a recombinant technology; the carrier protein has a G-X-Y ternary repetitive structure, G is glycine, and X and Y are independently selected from proline, alanine and glutamic acid;

the recombinant technology includes constructing an expression vector expressing the carrier protein, transforming a host cell with the expression vector, and culturing the host cell to express the carrier protein;

the chemical synthesis method includes sequentially connecting amino acid residues selected from glycine, proline, alanine and glutamic acid to a peptide chain according to the structure of the carrier protein, to form the carrier protein with a G-X-Y ternary repetitive structure.

The present disclosure further provides the use of glycine, proline, alanine and glutamic acid in the preparation of a carrier protein capable of improving biological properties or biological functions of a bioactive protein.

Various aspects of the present disclosure will be described in more detail below.

GS100R35; M1, Thyroglobulin, 669 kDa; M2, Ferritin (440 KD)+Aldolase (158 KD)+Conalbumin (75 KD)+Ovalbumin (44 KD).

Figure 3:
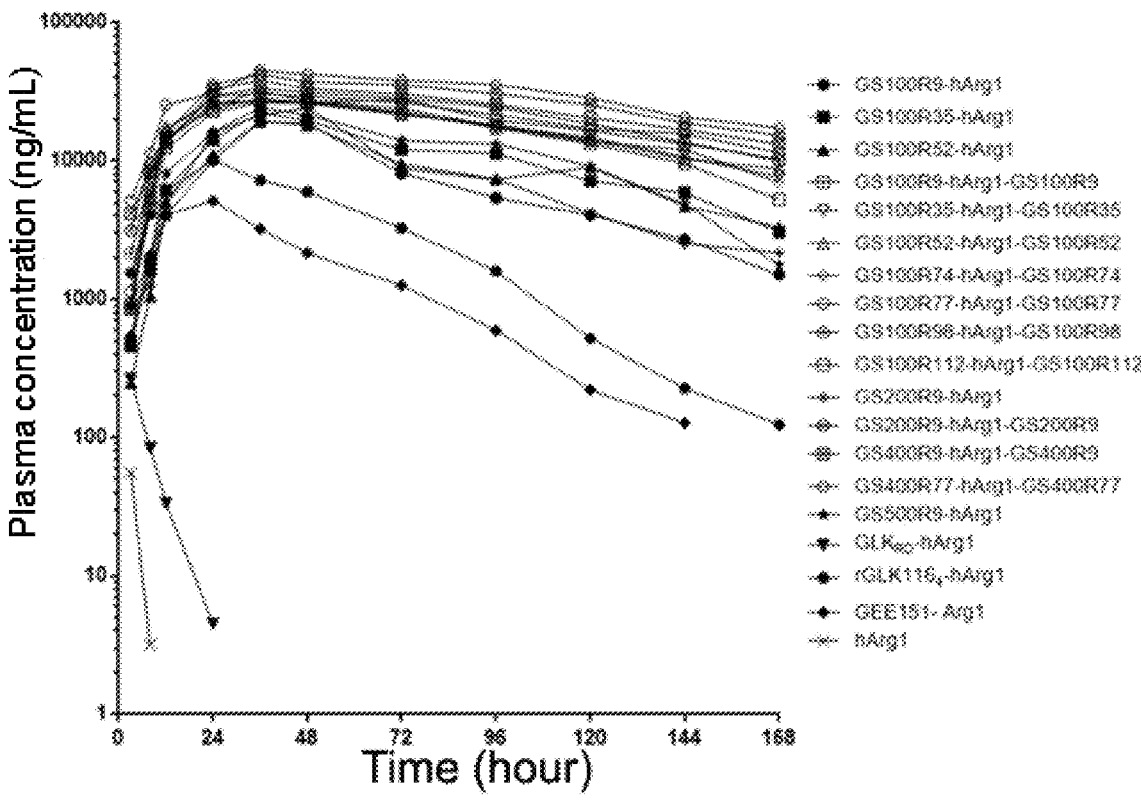

FIG. 3: pharmacokinetic results of GS-hArg1 fusion protein.

Figure 4:
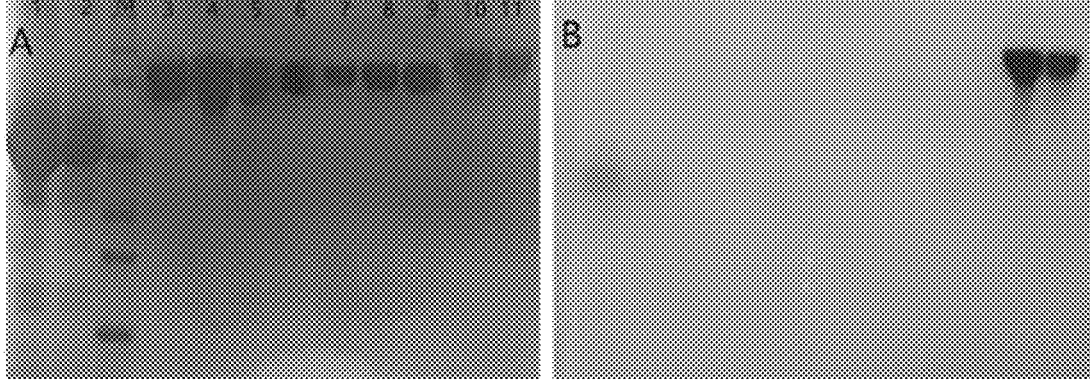

FIG. 4: glycosylation assay results of protein samples. A shows the results before glycosylation staining and B shows the results after glycosylation staining. Lanes 1-2: positive control proteins; Lane 3: GS100R9-hArg1-GS100R9; lane 4: GS100R35-hArg1-GS100R35; lane 5: GS100R52-hArg1-GS100R52; lane 6: GS100R74-hArg1-GS100R74; lane 7: GS100R77-hArg1-GS100R77; lane 8: GS100R98-hArg1-GS100R98; lane 9: GS100R112-hArg1-GS100R112. Lanes 10-11 are two independent batches of rGLK116$_4$-hArg1, respectively.

Figure 5:
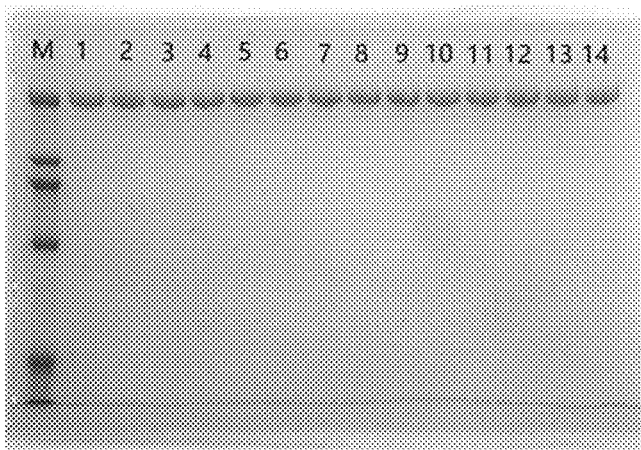
Figure 6:
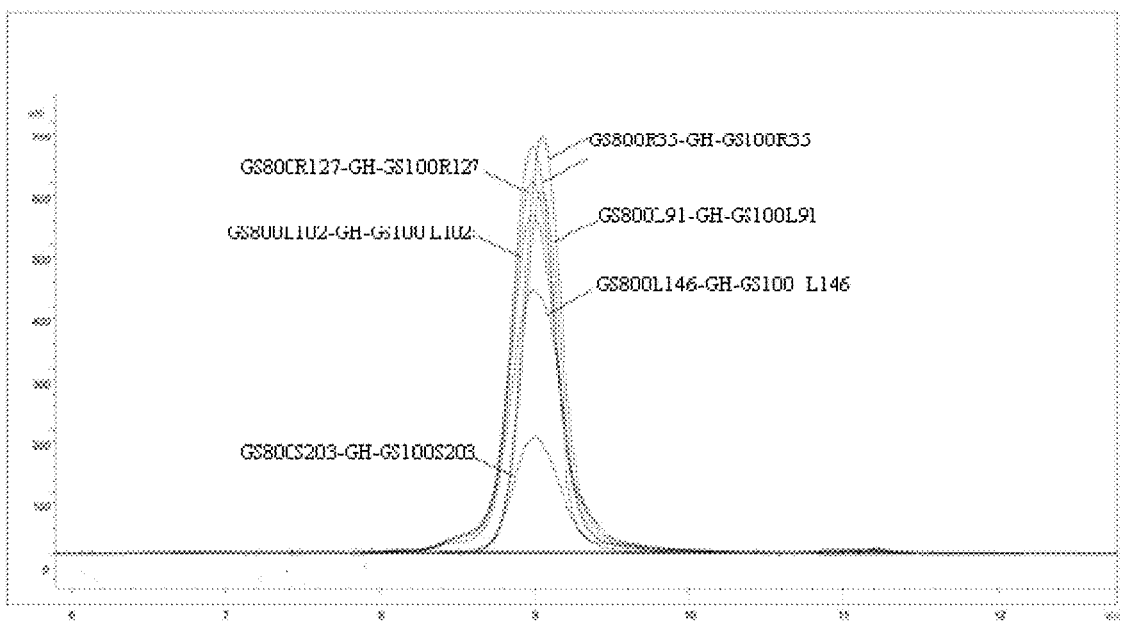

FIG. 5: SDS-PAGE electropherogram of GS-GH fusion proteins after treated with different temperatures. Lanes 1 and 8: GS800R9-GH-GS100R9; Lanes 2 and 9: GS800R35-GH-GS100R35; Lanes 3 and 10: GS800R127-GH-GS100R127; Lanes 4 and 11: GS800L91-GH-GS100L91; Lanes 5 and 12: GS800L102-GH-GS100L102; lanes 6 and 13: GS800L146-GH-GS100L146; Lanes 7 and 14: GS800S203-GH-GS100S203. Lanes 1-7 are samples left at room temperature for 30 min, lanes 8-14 are samples processed at 85° C. for 30 min. M is the protein molecular weight MARKER: 200 KD, 116 KD, 97.2 KD, 66.4 KD, and 44.3 KD;

FIG. 6: plot of the aggregates analysis of GS-hGH fusion protein samples.

Figure 7:
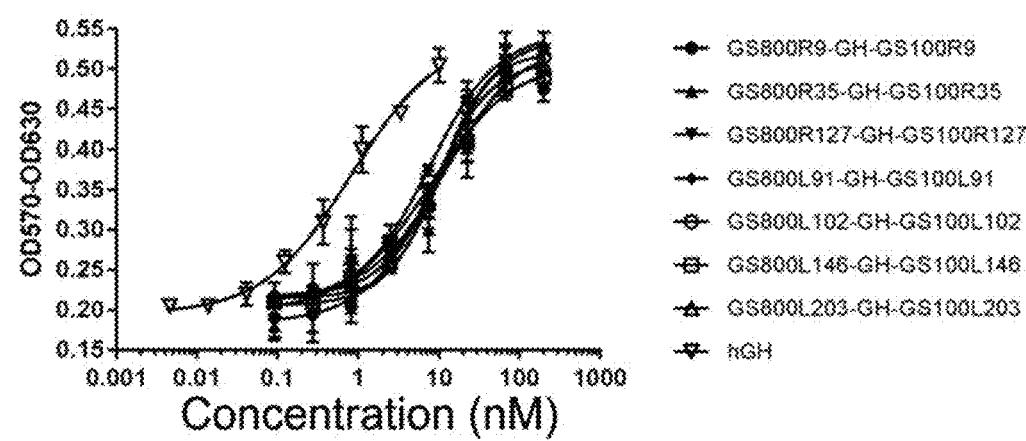

FIG. 7: in vitro cell viability results of GS-hGH fusion proteins.

Figure 8:
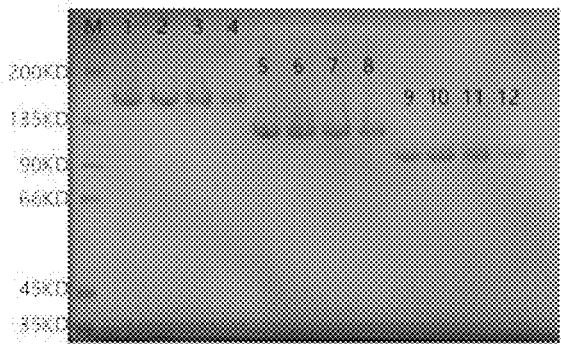

FIG. 8: SDS-PAGE electrophoretogram of GS-GDF15 fusion proteins. Lanes 1-4 are GS600R9-GDF15, GS600L23-GDF15, GS600L136-GDF15, GS600S14-GDF15, respectively; lanes 5-8 are GS400R9-GDF15, GS400L23-GDF15, GS400L136-GDF15, GS400S14-GDF15, respectively; lanes 9-12 are GS200R9-GDF15, GS200L23-GDF15, GS200L136-GDF15, GS200S14-GDF15, respectively.

Figure 9:
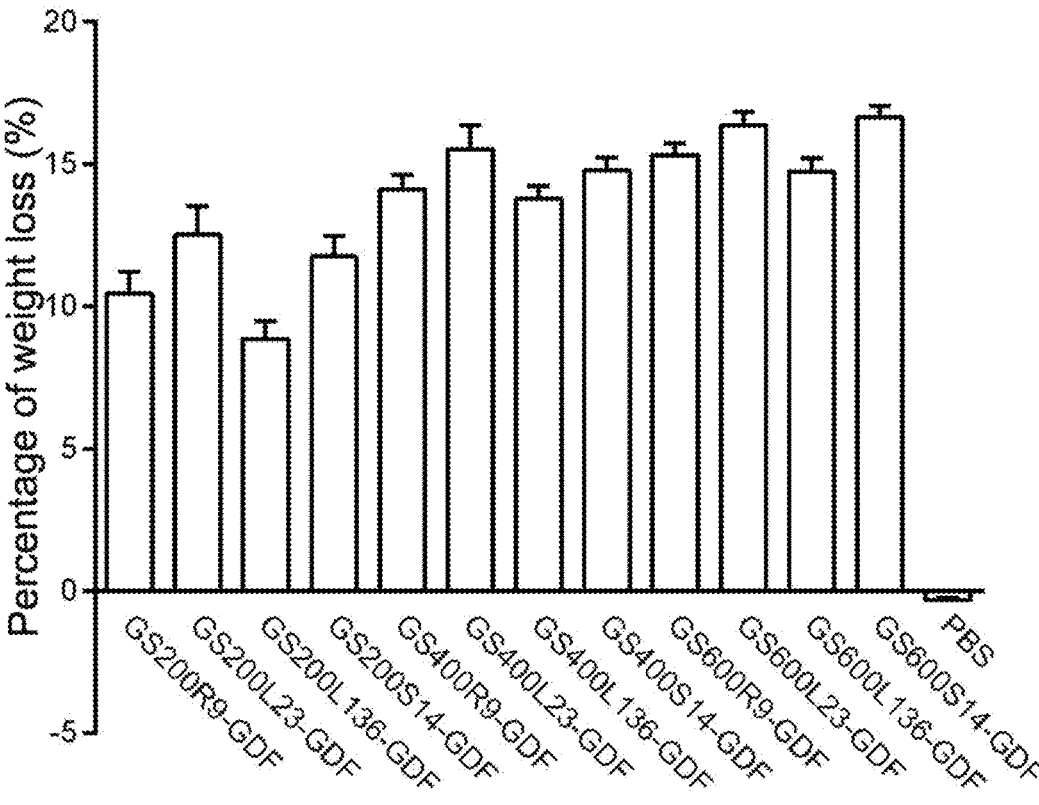

FIG. 9: weight loss effect of GS-GDF15 fusion proteins on DIO mice.

Figure 10:
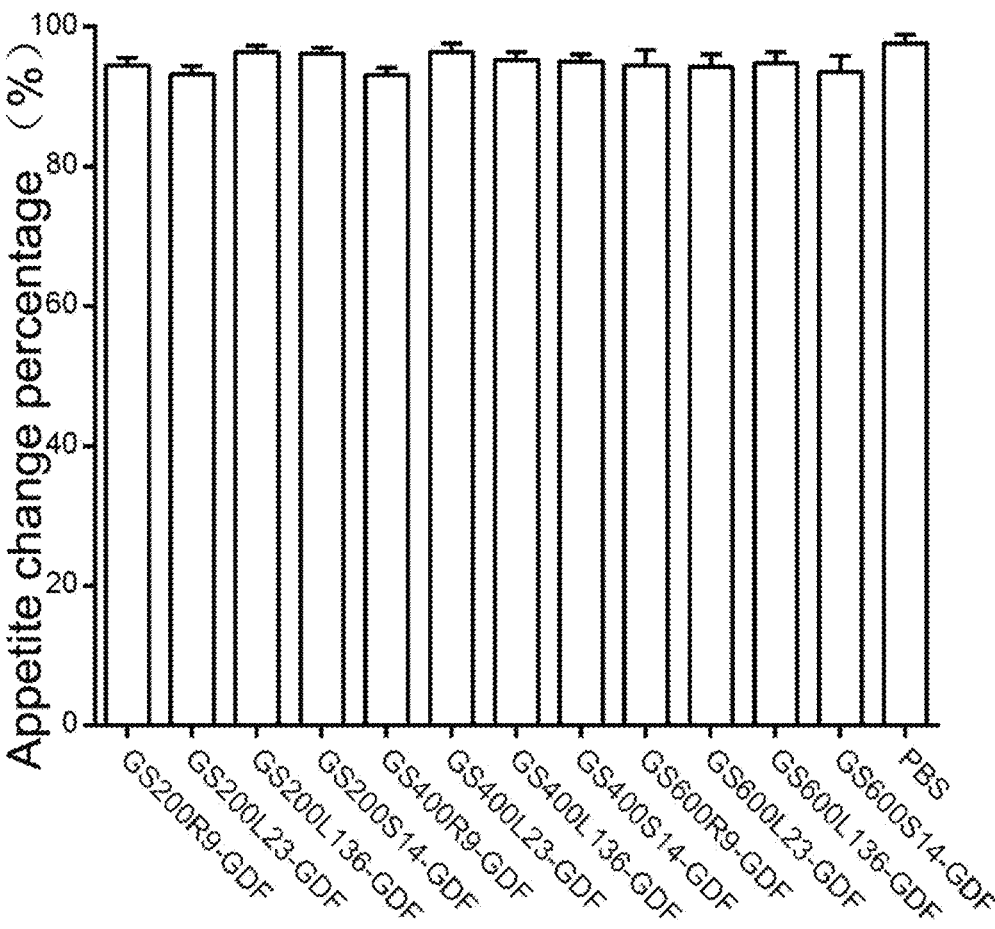

FIG. 10: appetite suppression effect of GS-GDF15 fusion proteins on DIO mice.

Figure 11:
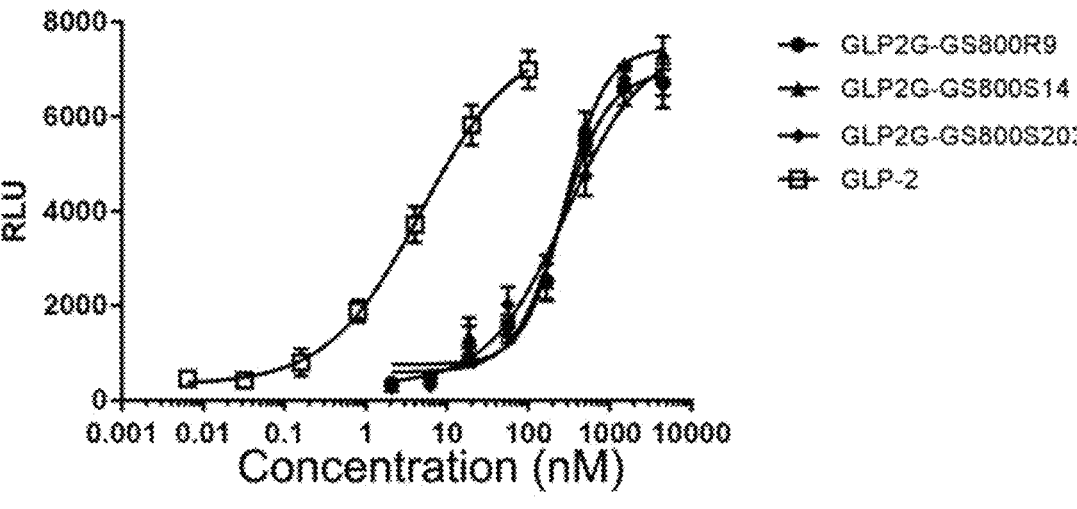

FIG. 11: in vitro cell viability detection results of GS-GLP2G fusion proteins.

Figure 12:
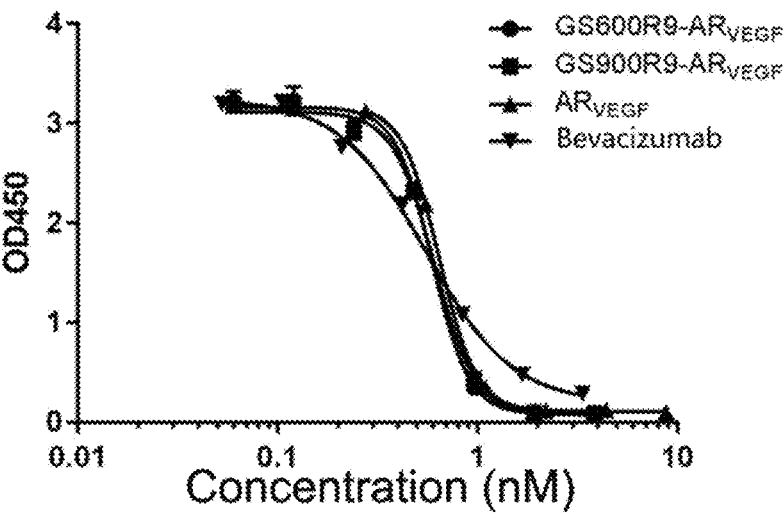

FIG. 12: in vitro cell viability results of GS-AR$_{VEGF}$ fusion proteins.

Figure 13:
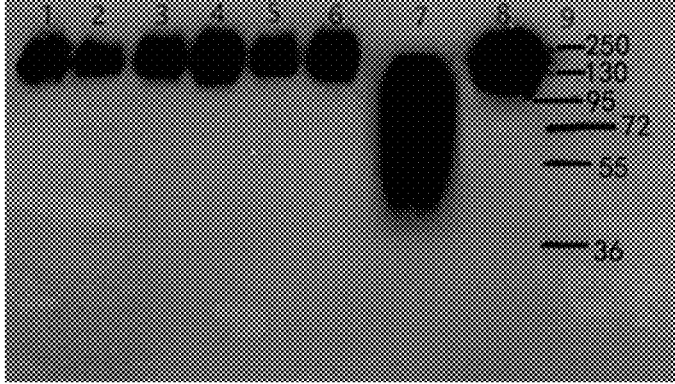

FIG. 13: GS-GH and rGLK116$_4$-hArg1 fusion proteins incubated in rat serum on the 7th day. 1, GS800R9-GH-GS100R9; 2, GS800R35-GH-GS100R35; 3, GS800R127-GH-GS100R127; 4, GS800L91-GH-GS100L91; 5, GS800L102-GH-GS100L102; 6, GS800L146-GH-GS100L146; 7, rGLK116$_4$-hArg1; 8, GS800S203-GH-GS100S203.

Figure 14:
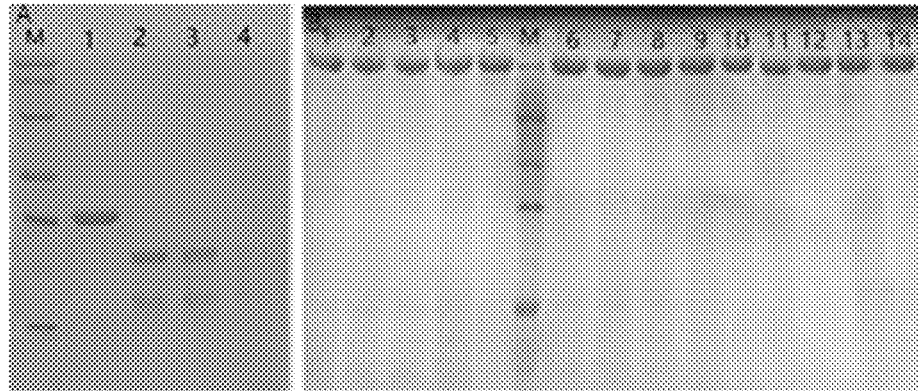

FIG. 14: stability results of GS-GH fusion proteins and hGH in trypsin. A. Lanes 1~4 are the results of hGH incubated in 0%, 0.02%, 0.1% and 0.5% trypsin for 40 min; M is a low molecular weight MARKER: 97.2 KD, 66.4 KD, 44 KD, 29 KD, 21 KD, and 14 KD; B. Lanes 1 and 2: GS800R9-GH-GS100R9; lanes 3 and 4: GS800R35-GH-GS100R35; lanes 5 and 6: GS800R127-GH-GS100R127; Lanes 7 and 8: GS800L91-GH-GS100L91; lanes 9 and 10: GS800L102-GH-GS100L102; lanes 11 and 12: GS800L146-GH-GS100L146; Lanes 13 and 14: GS800S203-GH-GS100S203. M is a high molecular weight MARKER: 220 KD, 135 KD, 90 KD, 66 KD, 45 KD, and 35 KD.

DETAILED DESCRIPTION OF THE PREFERRED EMBODIMENTS

It should be noted that, within the scope of the present disclosure, the above-mentioned technical features of the present disclosure and the technical features specifically described in the following (such as Embodiments) may be combined with each other to form a preferred technical solution.

Explanation of Terms

"Bioactive proteins/polypeptides" herein refer to proteins, antibodies, polypeptides, and fragments and variants thereof having one or more pharmacological and/or biological activities or functions (such as pharmacokinetic and physicochemical properties described herein) or functions such as targeted guidance and multimerization. The biologically active proteins/polypeptides may be naturally occurring or artificially constructed. "Bioactive proteins/polypeptides" may include enzymes, enzyme inhibitors, antigens, antibodies, hormones, coagulation factors, interferons, cytokines, growth factors, differentiation factors, factors related to bone tissue growth, factors related to bone factor absorption, chemotactic factors, cell motility factors, migration factors, cytostatic factors, bactericidal factors, antifungal factors, plasma adhesion molecules, interstitial adhesion molecules and extracellular matrix, receptor ligands, and fragments thereof.

In some embodiments, the "bioactivity" or "biological activity" of the present disclosure is expressed as "therapeutic activity". Therefore, In these embodiments, the biologically active protein/polypeptide involved in the present disclosure is a protein/polypeptide that exhibits "therapeutic activity", and this protein/polypeptide has one or more known biological and/or therapeutic activities. These activities are related to one or more of the therapeutic proteins described herein or other known therapeutic proteins. As a non-limiting example, "therapeutic protein" (which may be interchanged with "therapeutical protein" or "active protein drug" herein) refers to a protein useful for treating, preventing, or ameliorating diseases, symptoms, or functional disorders. As a non-limiting example, a "therapeutic protein" may be a protein that specifically binds to a specific cell type (for example, lymphocytes or cancer cells) and is localized on the cell surface (or subsequently endocytosed into the cell). In another non-limiting example, "therapeutic protein" refers to a bioactive protein, especially a bioactive protein useful for treating, preventing or ameliorating diseases. Non-limiting therapeutic proteins include proteins with biological activities such as increasing angiogenesis, inhibiting angiogenesis, regulating hematopoietic function, promoting neurodevelopment, improving immune response, and suppressing an immune response.

As mentioned above, "therapeutic activity" or "activity" may refer to an activity that achieves an effect consistent with a desired therapeutic result in humans, non-human mammals, or other species. The therapeutic activity may be measured in vivo or in vitro.

The "therapeutic proteins" of the present disclosure may include, but are not limited to: VEGF receptor or fragment thereof, TNF receptor, HER-2/neuromembrane receptor, human ErbB3 receptor secreted morphoisomer, transforming growth factor b III Type receptor extracellular domain, transforming growth factor b II type receptor extracellular domain, IL-1 receptor, IL-4 receptor, urokinase, β-glucocerebrosidase, arginine deiminase, Arginase, herstatin, epidermal growth factor, FGF-1, FGF-19, FGF-21, fibroblast growth factor-2, ordinary fibrocyte growth factor, nerve growth factor, platelet-derived growth factor, VEGF-1, IL-1, IL-2, IL-3, IL-4, IL-6, IL-8, IL-10, IL-11, IL-12, IL-15, IL-18, IL-21, IL-24, IL-IRA, RANKL, RANK, OPG, LEPTIN, interferon alpha, interferon beta, interferon gamma, interferon omega, TGF-beta, TGF-beta-1, TGF-beta-3, TNF alpha, atrial natriuretic peptide, B-type natriuretic peptide, gonadotropin, human luteinizing hormone, follicle stimulating hormone, human growth hormone, EPO, G-CSF, GM-CSF, TPO, M-CSF, SCF, VEGF, EPO mimic peptide, TPO mimic peptide, FLT3 ligand, Apo2 ligand, bone cell inhibitory factor, BMP-2, BMP-7, GLP-1 and analogs thereof, GLP-2 and analogs thereof, Exendin-3, Exendin-4 and analogs thereof, insulin and analogs thereof, GIP and analogs thereof, glucagon and analogs thereof, endostatin, plasminogen kringle 1 domain, plasminogen kringle 5 domain and angiostatin. The therapeutic protein may be antibodies and fragments thereof, especially antigen-binding fragments, including single-chain antibody scFv. These proteins and the nucleic acid sequences encoding these proteins are well known and can be found in public databases such as Chemical Abstracts Services Databases (such as CAS Registry), GenBank and GenSeq. For those skilled in the art, according to the spirit of the present disclosure, it is easy to understand that most of the biologically active proteins that have been discovered are applicable to the present disclosure. Of course, it should be understood that proteins/polypeptides with biological activity newly discovered after the present disclosure are also applicable to the present disclosure.

"Gelation" herein means that some solutions will gradually become viscous when cooled, and finally lose fluidity and become elastic jelly. Such a phenomenon is called gelation. The gelatin obtained by hydrolysis of natural collagen has certain specific properties. The properties of gelatin in an aqueous solution are affected by temperature, pH, production process and concentration. Gelation that is reversible to temperature is one of the most important properties of gelatin. (GELATIN HANDBOOK, GMIA, 2012).

As used herein, "PEG" and/or "PEGylation" refers to the covalent attachment of polyethylene glycol (PEG) polymer chains to the bioactive protein of interest. The covalent attachment of PEG to a bioactive protein can mask the protein from the attack by the host's immune system, and increase the hydrodynamic radius of the bioactive protein of interest, thereby prolonging the in-vivo cycling time of the protein drug by reducing renal clearance.

Sequence homology is used herein to describe the genetic relationship between species. Two sequences are homologous if they share a common evolutionary ancestor. When analyzing sequence homology, the sequence to be studied is generally added to a set of multiple sequences from different species, to determine the homology relationship between the sequence and other sequences. Commonly used analysis tools are CLUSTAL and so on.

Sequence identity herein refers to the percentage of identical residues in the sequences participating in the alignment. The sequence identity of two or more sequences may be calculated using calculation software well known in the art, such software may be obtained from NCBI.

Sequence similarity herein refers to the degree of similarity between several DNA, RNA or protein sequences, and can be understood as the percentage of identical residues in the sequences that participate in the alignment (identity %) or the percentage of residues having similar physical and chemical properties (similarity %). For example, the sequence similarity of two different protein sequences can be understood as the percentage of identical amino acid residues (identity %) in the two sequences or the percentage of amino acid residues with similar physical and chemical properties (similarity %) in the two protein sequences.

In addition to the above-mentioned terms, other terms used herein are intended to have their ordinary meanings in the art unless otherwise stated.

Gelatin-Like Unit (U)

The present disclosure provides a gelatin-like unit (U). The amino acid types constituting the gelatin-like unit are composed of glycine (G), proline (P), alanine (A) and glutamic acid (E). The gelatin-like unit (U) has a G-X-Y ternary monomer repetitive structure, G is glycine (G), and X and Y are independently selected from proline (P), alanine (A) and glutamic acid (E).

In some embodiments, the gelatin-like unit of the present disclosure may have the following repetitive structure:

(G-X-Y)n

G is glycine, and X and Y are independently selected from proline, alanine and glutamic acid; n is an integer of 5-20.

In some embodiments, the G-X-Y ternary monomer repetitive structure is selected from: GPP, GEE, GAA, GEA, GAE, GAP, GPA, GPE, and GEP. Therefore, in some embodiments, the gelatin-like unit (U) of the present disclosure may be composed of two or more G-X-Y ternary monomer repetitive structures selected from the following: GPP, GEE, GAA, GEA, GAE, GAP, GPA, GPE and GEP.

In some embodiments, the gelatin-like unit (U) of the present disclosure may be composed of at least 6 G-X-Y ternary monomers (i.e., $n \geq 6$), such as $6 \leq n \leq 20$ or $6 \leq n \leq 15$. In some embodiments, the gelatin-like unit (U) of the present disclosure may be composed of at least 9 G-X-Y ternary monomers, such as $9 \leq n \leq 20$ or $9 \leq n \leq 15$.

Generally, based on the optimization of the expression amount, the same G-X-Y ternary monomers do not appear consecutively, so as to avoid potential homologous recombination events.

In some embodiments, the gelatin-like unit of the present disclosure may be selected from the gelatin-like unit shown in any odd-numbered sequence in SEQ ID NO: 17-89. In some preferred embodiments, the gelatin-like unit of the present disclosure may be selected from SEQ ID NO: 17, SEQ ID NO: 19, SEQ ID NO: 21, SEQ ID NO: 25, SEQ ID NO: 27, SEQ ID NO:29 and SEQ ID NO: 31.

Gelatin-Like Protein (GS)

Further, the present disclosure provides a gelatin-like protein (GS) including at least two gelatin-like units (U) described herein. The gelatin-like protein herein may serve as a carrier protein for carrying bioactive proteins, especially active protein drugs.

In some embodiments, the core structure of the gelatin-like protein described herein is $U_1$-$U_2$ or $U_1$-$U_2$- ... $U_a$; $U_1$, $U_2$, . . . , $U_a$ each represents any gelatin-like unit described in any embodiment; a is an integer greater than or equal to 3. The gelatin-like units in the gelatin-like protein of the present disclosure may be the same or different. In some embodiments, $3 \leq a \leq 150$. In some embodiments, $3 \leq a \leq 100$. In some embodiments, $3 \leq a \leq 50$. It should be understood that a shall be selected so that the total number of amino acid residues of the gelatin-like proteins described herein is within the range described in any of the embodiments below. In addition to the core structure, the gelatin-like protein described herein may include other amino acid sequences that do not affect the biological properties (including but not limited to gelation, viscosity, product uniformity, serum stability, enzyme resistance stability and immunogenicity as described below) of the gelatin-like protein. For example, the N-terminal, C-terminal of the gelatin-like protein, and/or the appropriate region within the gelatin-like protein may include amino acid sequences used to promote expression, secretion into the outside of the host cells and/or purification when preparing the gelatin-like protein using recombinant technology, and the amino acid sequences include but are not limited to suitable linker sequences, signal peptides, leader peptides, and end extensions. In some embodiments, the amino acid sequence may be a protein tag, which may be FLAG, HA, Poly-His, GST, MBP, or c-Myc. These tags can be used to purify proteins. In some embodiments, the total number of amino acid residues in the core structure accounts for at least 70% of the total number of amino acid residues in the gelatin-like protein, preferably at least 80%, more preferably at least 85%, and still more preferably at least 90%, at least 95%, or at least 99%. In some embodiments, the gelatin-like protein of the present disclosure is composed of the gelatin-like units described in any embodiment.

Preferably, the content of Ala in the gelatin-like protein is greater than or equal to 10%. More preferably, the content of Ala is greater than or equal to 12%. More preferably, the content of Ala is greater than or equal to 15%. More preferably, the content of Ala is greater than or equal to 18%. More preferably, the content of amino acid Ala is greater than or equal to 20%. Preferably, the content of amino acid Ala does not exceed 45%, for example, does not exceed 40%, does not exceed 35%, or does not exceed 30%. Therefore, in some embodiments, the content of Ala in the GS of the present disclosure is within the range formed by any two of the above-listed values as endpoints, such as in the range of 10-45%, such as 12-45%, 15-45%, 18-45%, 20-45% or 10-40%, 10-30%, 10-20%, or 15-45%.

According to the GRAVY value representing hydrophilicity (Kyte J., Doolittle R F, J. Mol. Biol. 157:105-132, 1982), the amino acid Ala is 1.800, Glu is-3.500, Pro is-1.600, and Gly is-0.400. That is, Ala is a hydrophobic amino acid, and Glu, Pro and Gly are hydrophilic amino acids. In some embodiments, calculated according to the ProtParam formula, the gelatin-like protein (GS) has a GRAVY value (which represents hydrophilicity) greater than $-1.1$. Preferably, the GRAVY value is greater than or equal to $-1.0$. More preferably, the GRAVY value is greater than or equal to $-0.9$. More preferably, the GRAVY value is greater than or equal to $-0.8$. Preferably, the GRAVY value is at most 0, for example, at most $-0.1$ or at most $-0.2$. Therefore, in some embodiments, the gelatin-like protein (GS) of the present disclosure has a GRAVY value (which represents hydrophilicity) within the range formed by any two of the above-listed values as endpoints, such as within the range of $-1.1 < \text{GRAVY value} \leq 0$, such as $-1.1 < \text{GRAVY value} \leq -0.1$, $-1.0 \leq \text{GRAVY value} \leq 0$, $-0.9 \leq \text{GRAVY value} \leq 0$, $-0.8 \leq \text{GRAVY value} \leq 0$, or $-0.8 \leq \text{GRAVY value} \leq -0.1$, In some embodiments, the gelatin-like protein (GS) of the present disclosure has a GRAVY value (which represents hydrophilicity) ranging from $-1.0$ to $0.0$.

Therefore, the gelatin-like protein of the present disclosure generally has the following features: (1) containing the gelatin-like unit of the present disclosure; (2) the content of Ala being greater than or equal to 10%, preferably greater than or equal to 12%, more preferably greater than or equal to 15%, more preferably greater than or equal to 18%, more preferably greater than or equal to 20%; preferably, the content of Ala being less than or equal to 45%, such as less than or equal to 40% or less than or equal to 35%; and 3) the GRAVY value representing hydrophilicity being greater than −1.1, preferably greater than or equal to −1.0, more preferably greater than or equal to −0.9, more preferably greater than or equal to −0.8; preferably, the GRAVY value being less than or equal to 0, such as less than or equal to −0.1 or less than or equal to −0.2.

Generally, the gelatin-like protein (GS) of the present disclosure has at least 100 amino acids, preferably at least 200 amino acids, more preferably at least 300 amino acids, more preferably at least 400 amino acids, more preferably at least 500 amino acids, more preferably at least 600 amino acids, more preferably at least 700 amino acids, more preferably at least 800 amino acids, more preferably at least 900 amino acids, more preferably at least 1000 amino acids, and more preferably at least 1200 amino acids. In some embodiments, the gelatin-like protein of the present disclosure has 100-2000 amino acids, such as 200-2000, 300-2000, 400-2000, 500-2000, 600-2000, 700-2000, 800-2000, 900-2000, 1000-2000 or 1200-2000 amino acids.

In some preferred embodiments, the gelatin-like protein of the present disclosure is formed by repeated splicing of gelatin-like units (U) with the same sequence. In other preferred embodiments, the gelatin-like protein of the present disclosure is formed by the splicing of different gelatin-like units (U). In some embodiments, there may be linker sequences between the gelatin-like units, such as linker sequences formed by amino acid sequences containing glycine (G) and/or proline (P).

In some preferred embodiments, an exemplary gelatin-like protein of the present disclosure may be selected from a sequence shown in any odd-numbered sequence in SEQ ID NO: 91-185. In some preferred embodiments, the gelatin-like protein of the present disclosure may be formed by splicing any two or more (such as 2-20, 2-10 or 2-8) sequences shown in the odd-numbered sequences in SEQ ID NO: 91-185. Therefore, in these embodiments, the gelatin-like protein of the present disclosure may include 2-20 sequences selected from any odd-numbered sequence in SEQ ID NO: 91-185. Preferably, the two or more sequences used for splicing to form the gelatin-like protein of the present disclosure are the same sequence. Similarly, the spliced sequences may be connected with each other, or may be linked through linker sequences known in the art (for example, linker sequences formed by amino acid sequences containing glycine (G) and/or proline (P)). In some preferred embodiments, an exemplary gelatin-like protein of the present disclosure is selected from the gelatin-like protein contained in the fusion protein shown in any odd-numbered sequence in SEQ ID NO: 211-239, 247-259 and 263-309, including but not limited to the sequence of amino acid residues 1-231 (GS200R9) of SEQ ID NO: 231, the sequence of amino acid residues 1-573 (GS500R9) of SEQ ID NO: 239, the sequence of amino acid residues 1-915 (GS800R9) of SEQ ID NO: 263, the sequence of amino acid residues 1-864 (GS800R35) of SEQ ID NO: 265, the sequence of amino acid residues 1-864 (GS800R127) of SEQ ID NO: 267, the sequence of amino acid residues 1-864 (GS800L91) of SEQ ID NO: 269, the sequence of amino acid residues 1-864 (GS800L102) of SEQ ID NO: 271, the sequence of amino acid residues 1-864 (GS800L146) of SEQ ID NO: 273, the sequence of amino acid residues 1-915 (GS800S203) of SEQ ID NO: 275, the sequence of amino acid residues 1-216 (GS200L23) of SEQ ID NO: 279, the sequence of amino acid residues 1-216 (GS200L136) of SEQ ID NO: 281, the sequence of amino acid residues 1-231 (GS200S14) of SEQ ID NO: 283, the sequence of amino acid residues 1-687 (GS600R9) of SEQ ID NO: 293, the sequence of amino acid residues 1-648 (GS600L23) of SEQ ID NO: 295, the sequence of amino acid residues 1-648 (GS600L136) of SEQ ID NO: 297, the sequence of amino acid residues 1-687 (GS600S14) of SEQ ID NO: 299, the sequence of amino acid residues 34-948 (GS800S14) of SEQ ID NO: 303, the sequence of amino acid residues 34-948 (GS800S203) of SEQ ID NO: 305, and the sequence of amino acid residues 1-1029 (GS900R9) of SEQ ID NO: 309. In some embodiments, the amino acid sequence of the gelatin-like protein of the present disclosure has an identity percentage of at least 80%, more preferably at least 85%, more preferably at least 90%, more preferably at least 95% with any of the amino acid sequences described in this paragraph.

The vast majority of bioactive proteins for therapeutic use generally require low-temperature storage due to their high-level conformation. Therefore, carrier proteins of bioactive proteins need to have excellent solubility and low viscosity at both low temperature and normal temperature. If a gel is formed at a low temperature, the solubility will decrease, and the viscosity will increase significantly, creating additional obstacles to biologic drug preparation and patient delivery. Natural gelatin is formed by hydrolysis of collagen in connective tissues such as animal fur and bones through strong acid or strong alkali. The properties of gelatin can be easily affected by temperature, pH and concentration. Natural gelatin is freely soluble in hot water (>40° C.) and tends to form a gel at low temperatures. In addition, when the concentration of gelatin in the aqueous solution is higher than 0.5%, the viscosity will first increase at a temperature of 35-40° C., and then form a gel (Gelatin handbook, Gelatin Manufacturers Institute of America, 2012). Chinese Patent ZL200980103870.9 and Werten M W et al. (Werten M W et al., Secreted production of a custom-designed, highly hydrophilic gelatin in *Pichia pastoris*. Protein Eng. 14(6): 447-54.2001) respectively reported artificially designed and recombinantly expressed gelatin-like proteins. However, embodiments of the present disclosure indicate that the physicochemical properties of the GLK sequence from ZL200980103870.9 are very sensitive to changes in temperature. In other words, although these gelatin-like sequences were recombinantly expressed, they still retained the gelatination properties of natural gelatin to a large extent. In addition, on the basis of maintaining the G-X-Y ternary monomer structure, the more types of amino acids in the gelatin-like protein, the more similar its gelatination properties are to natural gelatin, that is, the more susceptible the gelatin-like protein is to gelatinization under the influence of temperature. Embodiments of the present disclosure reveal that proteins with more than 4 types of amino acids all have gelatination properties. When X and Y are independently selected from proline (P), alanine (A), or glutamic acid (E), the gelatination properties can be greatly eliminated, and the viscosity can be significantly reduced.

Further, in addition to intravenous infusion, injection administration routes such as subcutaneous injection, intramuscular injection, and vitreous injection have limitations on the dosing volume. For example, for ophthalmic vitreous administration, if more than 100 microliters are injected, the intraocular pressure will increase, which requires vitreous drainage to reduce the intraocular pressure. The maximum dosing volume for subcutaneous injection is generally not more than 2 ml. If the dosing volume exceeds 2 ml, a multi-site injection is required. Larger dosing volume often means that the burden of the administration route is added and the pain of the patient is increased. In order to reduce the dosing volume, pharmaceutical preparations often need to be prepared at higher concentrations. Therefore, high viscosity at room temperature is a serious defect for protein drugs. As a carrier protein, in addition to low immunogenicity and no other physiological activity, a very important condition is high solubility and low viscosity.

However, traditional carrier proteins, such as the recombinant fusion protein made of GLK fused with active protein as in Chinese Patent Application ZL200980103870.9, begin to gel at 25° C. or at concentrations higher than 10 mg/ml. Those carrier proteins are viscous and not suitable for clinical applications, i.e., they are not suitable as protein drug carriers.

Unlike the traditional carrier proteins, the gelatin-like protein (GS) provided by the present disclosure not only has no obvious gelation phenomenon, but also has extremely low viscosity, which is a more desirable protein drug carrier. In some embodiments, the gel strength of the gelatin-like protein of the present disclosure is ≤10 g, preferably ≤5 g, more preferably ≤3 g, as measured according to the method of Chinese national standard "Food Additive: Gelatin" GB6783-94 using a gel strength tester. For example, the gelatin-like protein of the present disclosure may have a gel strength between 1-10 g, or between 1-5 g or 1-3 g. In some embodiments, the viscosity of the gelatin-like protein of the present disclosure is ≤3 mPa·s, preferably ≤2 mPa·s, more preferably ≤1 mPa·s, as measured according to the method of Chinese national standard "Food Additive: Gelatin" GB6783-94 via ND-2 Brookfield viscosity. For example, in some embodiments, the gelatin-like protein of the present disclosure has a viscosity within a range of 0.01-3 mPa·s, preferably within a range of 0.05-1 mPa·s.

XTEN is a polypeptide composed of 6 amino acids (A, E, G, P, S, and T), including 8% A, 12% E, 18% G, 17% P, 28% S and 17% T (Volker Schellenberger et al., A recombinant polypeptide extends the in vivo half-life of peptides and proteins in a tunable manner, Nature Biotechnology., 27(12): 1186, 2009). XTEN is rich in S and T. PAS is composed of proline (P), alanine (A) and serine(S), and is also rich in S. However, during the study of the present disclosure, it was found that the addition of S and T would lead to serious glycosylation in the eukaryotic expression system. For macromolecular proteins that are not suitable for recombinant expression in a prokaryotic expression system and are not suitable for chemical synthesis, it is difficult to solve the problem of glycosylation with a carrier protein rich in S and T. For example, in one embodiment of the present disclosure, a sequence rich in S and/or T can be highly glycosylated when expressed in the Pichia pastoris. As we all know, generally there are two main types of glycosylation: 1. O-linked oligosaccharide glycosylation, where the binding site is at a serine or threonine residue; 2. N-linked oligosaccharide glycosylation, the binding site is at an asparaginic acid residue site of the Asn-X-Ser/Thr sequence, where X may be any amino acid except proline. The glycosylation system of yeast is different from that of humans. High degree of glycosylation, especially O-glycosylation, is prone to cause strong immunogenicity, and it is difficult to control batch inhomogeneity in the production process. Theoretically, when sequences rich in S or T (such as XTEN, PAS, GLK or URP) are expressed in an expression system other than a prokaryotic expression system, serious glycosylation and uneven product are extremely severe problems. Those problems can only be solved by first obtaining these sequences in a prokaryotic expression system and then chemically cross-linking the sequences with active proteins or polypeptides (which cannot or are difficult to express in a prokaryotic expression system) obtained in eukaryotic expression systems. However, it is well known that chemical cross-linking brings uneven products and tedious process, which are currently unsolvable problems.

In addition, the N-terminal structure of some proteins or peptides is closely related to their activity. For example, the N-terminal exposure of Exendin-4 or GLP-1 is critical for activity. However, when foreign proteins are expressed in prokaryotic systems (such as E. coli), they often have extra methionine at the N-terminal, which makes it difficult to directly obtain active products. Therefore, it is generally necessary to add a fusion expression tag, such as a CBD tag (Volker Schellenberger et al., A recombinant polypeptide extends the in vivo half-life of peptides and proteins in a tunable manner, Nature Biotechnology., 27(12)): 1186, 2009), in front of the N-terminal of Exendin-4, and cut the tag with a TEV protease after the expression is completed; or, to add other amino acids (such as two consecutive alanines) in front of the GLP-1 sequence, to improve the cleavage efficiency (M. Amiram et al., A depot-forming glucagon-like peptide-1 fusion protein reduces blood glucose for five days with a single Injection, J Control Release., 172(1):144-51, 2013), which is the only way to obtain a GLP-1 fusion protein with natural biological activity. The direct expression of GLP-1 fusion protein by yeast or cells can directly obtain GLP-1 active fusion protein with natural N-terminal sequence without additional protease digestion.

The gelatin-like protein (GS) of the present disclosure consists of glycine (G), proline (P), alanine (A), and glutamic acid (E) and can be prepared in either prokaryotic or eukaryotic expression systems without the problem of glycosylation. In addition, the inhomogeneity of GLK due to the deamidation of Asn (N) and Gln (Q) and the inhomogeneity of the product due to the degradation caused by the increase of potential protease sites due to the variety of amino acid are both extremely unlikely to exist in the gelatin-like protein (GS) provided by the present disclosure. As shown in the embodiments, the gelatin-like protein of the present disclosure has superior serum stability and enzyme resistance stability compared to GLK.

As a carrier protein, in-vivo immunogenicity is the most important factor. In the immunogenicity assay embodiment of the present disclosure, the antibody titer against rGLK116$_4$ (taken from Chinese Patent No. 200980103870.9) was relatively high after multiple administrations in rats, where the gelatin-like protein (GS) provided by the present disclosure shows almost no sign of immunogenicity. This result is inconsistent with that shown in Embodiment 4 of CN200980103870.9, probably because rGLK116$_4$ is used for coating (paragraph 213 of the specification). rGLK116$_4$ is an extremely hydrophilic sequence and is highly unsuitable as a coating protein. The ELISA plate and the protein are combined through hydrophobic interaction, and rGLK116$_4$ itself is extremely hydrophilic, so the amount of coating is very small, resulting in false-negative results.

Fusion Protein

The present disclosure further provides a fusion protein, which includes a bioactive protein and the gelatin-like protein described herein. As previously described, "bioactive protein" refers to a protein having one or more pharmacological and/or biological activities, or functions such as targeted guidance and multimerization. The bioactive proteins may be naturally occurring or artificially constructed. Bioactive proteins may include enzymes, enzyme inhibitors, antigens, antibodies, hormones, coagulation factors, interferons, cytokines, growth factors, differentiation factors, factors related to bone tissue growth, factors related to bone factor absorption, chemotactic factors, cell motility factors, migration factors, cytostatic factors, bactericidal factors, antifungal factors, plasma adhesion molecules, interstitial adhesion molecules and extracellular matrix, receptor ligands, and fragments thereof.

In some embodiments, the fusion protein of the present disclosure includes the active protein drug (D) and the gelatin-like protein (GS) of the present disclosure.

Active protein drugs suitable for use herein include, but are not limited to, agonists, receptors, ligands, antagonists, enzymes, and hormones. More specifically, active protein drugs suitable for use herein may be active protein drugs known in the art for use in the treatment and/or prevention and/or amelioration of symptoms of a variety of diseases including, but not limited to: metabolism-related diseases, cardiovascular diseases, blood coagulation/bleeding diseases, growth disorders or conditions, tumors, vascular disorders, inflammations, and autoimmune disorders. More specifically, the diseases include type 1 diabetes, type 2 diabetes, gestational diabetes, hypercholesterolemia, obesity, hyperglycemia, hyperinsulinemia, decreased insulin production, insulin resistance, metabolic disorder, polycystic ovarian syndrome, dyslipidemia, eating disorder, hypertension (such as pulmonary hypertension), retinal neurodegeneration, metabolic disorder, glucagonoma, ulcerative colitis, renal failure, congestive heart failure, nephrotic syndrome, nephropathy, diarrhea, postoperative dumping syndrome, irritable bowel syndrome, critically ill polyneuropathy, systemic inflammatory response syndrome, dyslipidemia, stroke, coronary heart disease, hemophilia, GH deficiency in adults and children, Turner syndrome, chronic renal failure, intrauterine growth retardation, idiopathic short stature, AIDS consumption, obesity, multiple sclerosis, aging, fibromyalgia, Crohn's disease, ulcerative colitis, muscular dystrophy, and low bone density. In some embodiments, the active protein drug of the present disclosure is the therapeutic protein described above.

Bioactive proteins (especially active protein drugs) may be tandemly fused with the gelatin-like proteins in a manner known in the art. For example, the bioactive protein may be fused to the N-terminal or C-terminal of the gelatin-like protein, or the gelatin-like protein may be fused to the two ends of the bioactive protein, or the bioactive protein may be fused to the two ends of the gelatin-like protein. The fusion protein may include two or more bioactive proteins, and the bioactive proteins may be the same or different. Similarly, the fusion protein may further include two or more gelatin-like proteins, and the gelatin-like proteins may be the same or different. When two or more bioactive proteins and/or two or more gelatin-like proteins are included, the bioactive proteins may be tandemly fused with the gelatin-like proteins in diverse manners. Exemplary tandem fusions include, but are not limited to the following structures:

D-GS;

GS-D;

$D_1$-GS-$D_2$;

$GS_1$-D-$GS_2$;

$GS_1$-$D_1$-$GS_2$-$D_2$-$GS_3$-$D_3$;

$GS_1$-$D_1$-$D_2$-$GS_2$-$D_3$;

$GS_1$-$D_1$-$GS_2$-$D_2$-$D_3$;

$GS_1$-$D_1$-$GS_2$-$D_2$-$D_3$-$GS_3$;

$D_1$-$GS_1$-$D_2$-$GS_2$-$D_3$;

$GS_1$-$D_1$-$GS_2$-$D_2$-$GS_3$-$D_3$-$GS_4$-$D_4$;

$D_1$-$GS_1$-$D_2$-$GS_2$-$D_3$-$GS_3$-$D_4$-$GS_4$;

$D_1$, $D_2$, $D_3$, and $D_4$ are active protein drugs, and $D_1$, $D_2$, $D_3$, and $D_4$ may be the same or different; $GS_1$, $GS_2$, $GS_3$, and $GS_4$ are gelatin-like proteins (GS), and $GS_1$, $GS_2$, $GS_3$, and $GS_4$ may be the same or different.

Generally, when there are two or more bioactive proteins and/or two or more GSs in the fusion protein, the bioactive proteins are usually linked to each other via GSs, and the GSs are also usually not directly linked to each other, but are linked via the bioactive proteins. In some embodiments, the active protein drugs listed in Table 1 below or their analogs are preferably used herein.

TABLE 1

| Active protein | SEQ ID NO: | Active protein | SEQ ID NO: |
|---|---|---|---|
| GLP-2 analog | 1 | Glucagon | 2 |
| $AR_{VEGF}$ | 3 | IL-2 | 4 |
| hGH | 5 | IL-15 | 6 |
| Arginase 1 | 7 | FGF19 | 8 |
| G-CSF | 9 | EPO | 10 |
| Exendin-4 | 11 | IL-6 | 12 |
| GLP-1 analog | 13 | M-CSF | 14 |
| GDF15 | 15 | FGF-21 | 16 |

After fusing the gelatin-like protein (GS) of the present disclosure, the physicochemical properties of the bioactive proteins, particularly the active protein drugs (D), are significantly improved, as evidenced by the increased water solubility, enzyme resistance stability and thermostability, and increased hydrokinetic radius. These desirable properties result in a significantly prolonged in-vivo half-life of the bioactive protein. In some embodiments of the present disclosure, the half-life of the fusion protein is more than 10 times longer than that when it is not fused.

It should be understood that in gene cloning operations, it is often necessary to design suitable restriction enzyme cutting sites, which inevitably introduce one or more irrelevant residues at the end of the to-be-expressed amino acid sequence without affecting the activity of the target sequence. In order to construct a fusion protein, to facilitate expression of a recombinant protein, to obtain a recombinant protein that is automatically secreted outside of the host cell, or to facilitate purification of a recombinant protein, it is often necessary to add a number of amino acids (e.g., including, but not limited to, suitable linker peptides, signal peptides, leader peptides, and end extensions) to the N-terminal, C-terminal, and/or other suitable regions within the recombinant protein. Therefore, the amino terminal and/or carboxy terminal of the fusion protein of the present disclosure may further include one or more polypeptide fragments as protein tags. Any suitable tag can be used herein. For example, the tags may be FLAG, HA, Poly-His, GST, MBP, c-Myc, which can be used for the purification of the protein.

In addition, a suitable linker sequence, such as a linker sequence containing G (glycine) and/or S (serine), may be provided between the bioactive protein and GS, between two bioactive proteins, or even between two GSs. Any linker sequence known in the art may be used in the fusion protein of the present disclosure.

In a preferred embodiment, the gelatin-like protein in the fusion protein of the present disclosure may be selected from a sequence shown in any odd-numbered sequence in SEQ ID NO: 91-185, a sequence of amino acid residues 1-231 (GS200R9) of SEQ ID NO: 231, a sequence of amino acid residues 1-573 (GS500R9) of SEQ ID NO: 239, a sequence of amino acid residues 1-915 (GS800R9) of SEQ ID NO: 263, a sequence of amino acid residues 1-864 (GS800R35) of SEQ ID NO: 265, a sequence of amino acid residues 1-864 (GS800R127) of SEQ ID NO: 267, a sequence of amino acid residues 1-864 (GS800L91) of SEQ ID NO: 269, a sequence of amino acid residues 1-864 (GS800L102) of SEQ ID NO: 271, a sequence of amino acid residues 1-864 (GS800L146) of SEQ ID NO: 273, a sequence of amino acid residues 1-915 (GS800S203) of SEQ ID NO: 275, a sequence of amino acid residues 1-216 (GS200L23) of SEQ ID NO: 279, a sequence of amino acid residues 1-216 (GS200L136) of SEQ ID NO: 281, a sequence of amino acid residues 1-231 (GS200S14) of SEQ ID NO: 283, a sequence of amino acid residues 1-432 (GS400L23) of SEQ ID NO: 287, a sequence of amino acid residues 1-432 (GS400L136) of SEQ ID NO: 289, a sequence of amino acid residues 1-459 (GS400S14) of SEQ ID NO: 291, a sequence of amino acid residues 1-687 (GS600R9) of SEQ ID NO: 293, a sequence of amino acid residues 1-648 (GS600L23) of SEQ ID NO: 295, a sequence of amino acid residues 1-648 (GS600L136) of SEQ ID NO: 297, a sequence of amino acid residues 1-648 (GS600S14) of SEQ ID NO: 299, a sequence of amino acid residues 34-948 (GS800S14) of SEQ ID NO: 303, a sequence of amino acid residues 34-948 (GS800S203) of SEQ ID NO: 305, and a the sequence of amino acid residues 1-687 (GS900R9) of SEQ ID NO: 309, or an amino acid sequence having an identity percentage of at least 80%, preferably at least 85%, more preferably at least 90%, more preferably at least 95% with any of the amino acid sequences described in this paragraph.

An exemplary fusion protein may be selected from the fusion proteins shown in any odd-numbered sequence in SEQ ID NOs: 211-239, 247-259 and 263-309, or a fusion protein having an identity percentage of at least 80%, preferably at least 85%, more preferably at least 90%, more preferably at least 95% with any of the fusion proteins described in this paragraph.

Figures 1, 2:
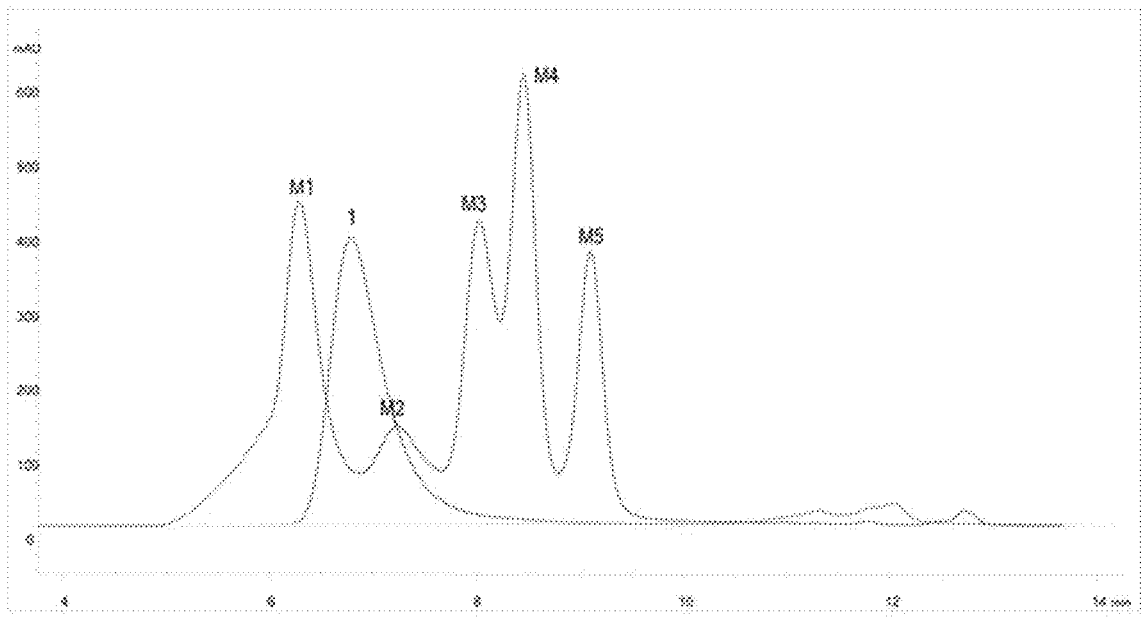
FIG. 1: apparent molecular weight of GS100R9-hArg1 fusion protein on Sepax SRTSEC-300 Å. 1. GS100R9-hArg1; M1, Thyroglobulin, 669 kDa; M2, Ferritin, 440 KDa; M3, Aldolase, 158 KD; M4, Conalbumin, 75 KD; M5, Ovalbumin, 44 KD.
FIG. 2: apparent molecular weight of GS-hArg1 fusion protein on SRT-1000 SEC. 1, GS200R9-hArg1-GS200R9; 2, GS100R9-hArg1-GS100R9; 3, GS100R35-hArg1-

The gelatin-like protein (GS) of the present disclosure, when fused with a bioactive protein or polypeptide, can enhance the pharmacokinetic properties of the bioactive protein or polypeptide. The half-life of the bioactive protein or polypeptide fused with the gelatin-like protein (GS) can be prolonged by more than 2 times. The pharmacokinetic properties are determined by measuring the terminal half-life of the bioactive protein administered to the subject and comparing the measured terminal half-life with that of the bioactive protein fused with the gelatin-like protein (GS) and administered at a corresponding dose. The essence of the ability of gelatin-like proteins (GS) to play a role in prolonging the half-life in vivo is due to their extremely large hydrodynamic radius. Compared to other spherical proteins of the same molecular weight, gelatin-like proteins (GS) are able to reach the nanometer level in size due to full stretching. In an embodiment of the present disclosure (the results are shown in FIGS. 1 and 2), the apparent molecular weight of GS100R9-hArg1 with a molecular weight of about 140 KD is between 669 KD and 440 KD. The apparent molecular weight of GS100R9-hArg1-GS100R9 and GS100R35-hArg1-GS100R35 with a molecular weight of about 170 KD is greater than 669 KD, while the apparent molecular weight of GS200R9-hArg1-GS200R9 with a molecular weight of about 220 KD is far greater than 669 KD.

Human arginase 1 (hArg1) is a natural trimeric structure. The molecular weight of its monomer is about 35 KD, and the molecular weight of its trimer is about 105 KD. Although this molecular weight is well above the glomerular filtration pore size, the half-life of human arginase 1 in vivo is surprisingly short, only a few minutes (P. N. Cheng, T. L. Lam, W. M. Lam, S. M. Tsui, A. W. Cheng, W. H. Lo, et al., Pegylated recombinant human arginase (rhArg-PEG5,000 mw) inhibits the in vitro and in vivo proliferation of human hepatocellular carcinoma through arginine depletion, Cancer Res. 67(2007) 309-317). The in-vivo half-life of human arginase 1 is usually prolonged by PEGylation modification. The half-life of PEG-hArg1 can be extended to 63 hours after administration in mice. In an embodiment of the present disclosure, the half-life of hArg1 is significantly prolonged after fusing gelatin-like proteins (GS) with similar amino acid lengths (about 100 amino acids) and different sequences. The C-terminal (S-shaped tail) of hArg1 is involved in the formation of trimers, but surprisingly, in the present disclosure, fusion of the gelatin-like protein (GS) at the C-terminal of hArg1 does not affect its formation of trimers. Moreover, a significant improvement in pharmacokinetic properties can be observed with gelatin-like protein (GS) fused at only one end or at both ends of hArg1, and the half-life is longer when the gelatin-like protein (GS) is fused at both ends, given the same length of gelatin-like protein (GS).

In another embodiment of the present disclosure, human growth hormone (hGH) is employed to validate the function of gelatin-like proteins (GS) in improving pharmacokinetic properties. In another embodiment of the present disclosure, growth differentiation factor 15 (GDF15) is employed to validate the function of gelatin-like proteins (GS) in improving pharmacokinetic properties. In another embodiment of the present disclosure, designed ankyrin repeat proteins capable of binding VEGF are employed to validate the function of gelatin-like proteins (GS) in improving pharmacokinetic properties. In another embodiment of the present disclosure, GLP2G is employed to validate the function of gelatin-like proteins (GS) in improving pharmacokinetic properties. In these embodiments, despite the different gelatin-like protein (GS) sequences employed, the effects of these gelatin-like proteins (GS) in extending the half-life in vivo are similar, and the effects are all proportional to length. Compared to GLK of the same length, gelatin-like protein (GS) has a more significant effect in extending the half-life.

In addition, the bioactive proteins fused with the gelatin-like protein (GS) have significantly improved solubility and stability, such as thermostability, enzyme resistance stability and serum stability. In an embodiment of the present disclosure, GH protein fused with gelatin-like protein (GS) has significantly higher thermal stability at 85° C. than unfused GH. Moreover, GH is prone to aggregation during preparation, but no significant aggregation is observed on SEC-HPLC after the fusion of gelatin-like protein (GS). In addition, the potential human circulatory stability of the bioactive protein is determined by measuring the integrity maintained after 7 days of exposure to 37° C. As shown in the WB results in FIG. 13, the GS fusion protein is highly stable in serum, while the control rGLK116₄-Arg1 protein has been degraded in a diffuse manner.

Chemical Conjugates with Therapeutic Activity

Antibody-drug conjugates (ADC) are therapeutic drugs prepared by antibodies and toxic compounds or radionuclides via lysine, cysteine, unnatural amino acids and engineered tags. A prominent disadvantage of ADC drugs is that the entire ADC molecule is prone to aggregate and even produce insoluble precipitates due to the cross-linking of highly hydrophobic toxic compounds or radionuclides, especially when the drug/antibody ratio (DAR) is high. In order to solve this problem, chemically synthesized highly hydrophilic polyethylene glycol (PEG) or biodegradable short-chain molecules may serve as linkers, such as PHF (also known as Fleximer®). These methods can effectively improve the hydrophilicity and stability of ADC molecules.

Similarly, when the protein with therapeutic activity is of very small molecular weight or is a polypeptide that is not suitable for recombinant expression, chemical cross-linking is preferred. In the present disclosure, the protein with therapeutic activity may be prepared by chemical cross-linking of several different active protein drugs (D) and the gelatin-like protein (GS). Chemical cross-linking can be performed on most amino acid residues. For example, the nucleophilic primary amine group on lysine and the active sulfhydryl group on cysteine are the most commonly used cross-linking sites. In addition, tyrosine and selenocysteine may be used for chemical cross-linking.

Polynucleotide Sequences, Nucleic Acid Constructs and Host Cells

The present disclosure includes coding sequences encoding various gelatin-like units, gelatin-like proteins, and fusion proteins provided herein, and complementary sequences thereof. An exemplary coding sequence of a gelatin-like unit is shown in any even-numbered sequence in SEQ ID NO: 18-90. An exemplary coding sequence of a gelatin-like protein is shown in any even-numbered sequence in SEQ ID NO: 92-186, or is a gelatin-like protein coding sequence contained in a fusion protein coding sequence shown in any even-numbered sequence in SEQ ID NO: 212-240, 248-260 and 264-310. An exemplary fusion protein coding sequence is shown in any even-numbered sequence in SEQ ID NO: 212-240, 248-260 and 264-310. The polynucleotide sequence may be prepared by methods commonly known in the art. For example, a small fragment of gelatin-like protein unit (U) may be obtained by gene synthesis, and then a gelatin-like protein (GS) with a larger molecular weight may be obtained by gene splicing from repeated splicing of that gelatin-like protein unit (U).

The present disclosure further provides nucleic acid constructs. Nucleic acid constructs are artificially constructed nucleic acid segments that can be introduced into target cells or tissues. The nucleic acid construct includes the coding sequences described herein or complementary sequences thereof, and one or more regulatory sequences operatively linked to these sequences. The regulatory sequence may be a suitable promoter sequence. The promoter sequence is usually operatively connected to the coding sequence of the amino acid sequence to be expressed. The promoter may be any nucleotide sequence that shows transcriptional activity in the selected host cell, including mutant, truncated and hybrid promoters, and may be obtained from genes encoding extracellular or intracellular polypeptides that are homologous or heterologous to the host cell. The regulatory sequence may also be a suitable transcription terminator sequence, which is a sequence recognized by the host cell to terminate transcription. The terminator sequence is connected to the 3'end of the nucleotide sequence encoding the polypeptide. Any terminator that is functional in the selected host cell can be used in the present disclosure.

In some embodiments, the nucleic acid construct is a vector. Specifically, the coding sequences described herein, particularly the coding sequences of gelatin-like proteins or fusion proteins, may be cloned into many types of vectors, including but not limited to plasmids, phages, phage derivatives, animal viruses, and cosmids. The vector may be an expression vector or a cloning vector.

Generally, a suitable vector may contain an origin of replication that functions in at least one organism, a promoter sequence, a convenient restriction enzyme site, and one or more selectable markers. Representative examples of these promoters include: the lac or trp promoter of *E. coli*; the lambda phage PL promoter; eukaryotic promoters (including CMV immediate early promoter, HSV thymidine kinase promoter, early and late SV40 promoters, methanol oxidase promoter of *Pichia pastoris*) and other well-known promoters that are capable of controlling gene expression in prokaryotic cells or eukaryotic cells or viruses. Marker genes may be used to provide phenotypic characters for the selection of transformed host cells. For example, marker genes may include but are not limited to dihydrofolate reductase, neomycin resistance and green fluorescent protein (GFP) for eukaryotic cell culture, or tetracycline resistance or ampicillin resistance for *E. coli*. When the polynucleotides described herein are expressed in higher eukaryotic cells, transcription will be enhanced if an enhancer sequence is inserted into the vector. Enhancers are cis-acting factors of DNA, typically containing about 10-300 base pairs. Enhancers act on promoters to enhance gene transcription.

Those skilled in the art understand how to select appropriate vectors, promoters, enhancers and host cells. Expression vectors containing the polynucleotide sequences described herein and suitable transcriptional/translational control signals may be constructed using methods known to those skilled in the art. These methods include in vitro recombinant DNA technology, DNA synthesis technology, and in vivo recombination technology.

The present disclosure further includes host cells including the polynucleotide sequences described herein or nucleic acid constructs thereof, and/or amino acid sequences expressing the gelatin-like units (especially the gelatin-like protein) described herein. The host cell may be a prokaryotic cell, such as a bacterial cell; a lower eukaryotic cell, such as a yeast cell; a filamentous fungal cell, or a higher eukaryotic cell, such as a mammalian cell. Representative examples of host cells include: *Escherichia coli* and *Streptomyces*; bacterial cells of *Salmonella typhimurium*; fungal cells (such as yeast cells and filamentous fungal cells) and plant cells; insect cells of *Drosophila* S2 or Sf9; CHO cells, COS cells, 293 cells, and animal cells from Bowes melanoma cells.

The vectors may be introduced into host cells by conventional methods, such as microinjection, gene gun, electroporation, virus-mediated transformation, electron bombardment, and calcium phosphate precipitation.

Pharmaceutical Composition

The present disclosure provides a pharmaceutical composition including the fusion protein described herein. The pharmaceutical composition may further include various suitable pharmaceutically acceptable carriers or excipients known in the art. The pharmaceutically acceptable carriers or excipients are non-toxic to the recipient at the dose and concentration used, and include, but are not limited to: buffers, such as acetate, Tris, phosphate, citrate and other organic acids; antioxidants, including ascorbic acid and methionine; preservatives (such as octadecyl dimethyl benzyl ammonium chloride; hexamethonium chloride; benzalkonium chloride, benzethonium chloride; phenol, butanol or benzyl alcohol; alkyl ester of p-hydroxybenzoic acid, such as methyl p-hydroxybenzoate or propyl p-hydroxybenzoate; catechol; resorcinol; cyclohexanol; 3-pentanol; and m-cresol); proteins, such as serum albumin, gelatin or immunoglobulin; hydrophilic polymers, such as polyvinylpyrrolidone; amino acids, such as glycine, glutamine, asparagine, histidine, arginine or lysine; monosaccharides, disaccharides and other carbohydrates, including glucose, mannose or dextrin; chelating agents, such as EDTA; tension conditioning agents, such as trehalose and sodium chloride; sugars, such as sucrose, mannitol, trehalose or sorbitol; surfactants, such as polysorbate; salt-forming counterions, such as sodium; metal complexes (such as Zn-protein complexes); and/or non-ionic surfactants, such as TWEE®, PLURONICS® or polyethylene glycol (PEG). Pharmaceutical formulations for in vivo administration are generally sterile, which can be easily achieved through sterile membrane filtration.

A suitable pharmaceutically acceptable carrier or excipient may be selected depending on the dosage form of the pharmaceutical composition. The pharmaceutical compositions may be prepared into different dosage forms according to their different uses. For example, the pharmaceutical composition of the present disclosure may be prepared into common dosage forms such as tablets, injections, and lyophilized agents.

The pharmaceutical composition typically includes therapeutically or prophylactically effective amounts of the fusion proteins described herein. A therapeutically effective amount usually refers to a dose that is sufficient to demonstrate benefit to the person to whom it is administered. The actual amount administered, as well as the rate and time course of administration, will depend on the individual's own condition and severity. The prescription of treatment (e.g., decisions on dosage) is ultimately the responsibility of and dependent on the general practitioner and other physicians, usually taking into account the disease being treated, the individual patient's condition, the site of delivery, the method of administration, and other factors known to the physician. A prophylactically effective amount refers to an amount effective to achieve a desired preventive effect at the necessary dosage and time period. Usually, but not necessarily, since the preventive dose is administered to a subject before the onset of the disease or in the early stage of the disease, the "prophylactically effective amount" will be lower than the "therapeutically effective amount".

Method and Use

The amino acid sequence of the present disclosure may be a product of chemical synthesis, or a recombinant polypeptide produced from prokaryotic or eukaryotic hosts (for example, bacteria, yeast, filamentous fungi, higher plants, insects, and mammalian cells) using recombinant technology. Depending on the host used in the recombinant production protocol, the active protein or polypeptide portion of the present disclosure may be glycosylated or non-glycosylated.

Therefore, in some embodiments, the present disclosure provides a method for preparing a protein therapeutic drug, including the following operations:
1) culturing a host cell including a coding sequence of a fusion protein of the present disclosure or an expression vector thereof, such that the host cell expresses the fusion protein;
2) collecting the culture containing the fusion protein; and
3) separating the fusion protein from the culture.
Methods for cell culturing may be determined depending on different cell types.

In some embodiments, the present disclosure further provides a method for treating or preventing a disease, including administering to a subject in need thereof a therapeutically effective amount or a prophylactically effective amount of a fusion protein or pharmaceutical composition thereof as described herein. The disease to be treated is related to the biological activity or function of the bioactive protein in the fusion protein. For example, growth hormone (GH) can promote the growth of bones, internal organs and the whole body, promote protein synthesis and affect fat and mineral metabolism, and can be used for growth disorders caused by insufficient secretion of endogenous pituitary growth hormone, short dwarf children with dwarfism or runt disease, as well as for the treatment of burns, fractures, trauma, bleeding ulcers, muscular dystrophy, osteoporosis and other diseases. Therefore, when the active protein drug in the fusion protein is GH, the fusion protein can be used for the treatment of growth disorders caused by insufficient secretion of endogenous pituitary growth hormone, short dwarf children with dwarfism or runt disease, as well as for the treatment of burns, fractures, trauma, bleeding ulcers, muscular dystrophy, osteoporosis and other diseases. For another example, IL-2 has an important role in immune response and antiviral infection, and is used clinically as an immune enhancer, mainly for kidney cancer, melanoma and non-Hodgkin's lymphoma. Therefore, when treating patients with kidney cancer, melanoma or non-Hodgkin's lymphoma, the fusion protein including IL-2 according to the present disclosure may serve as an active protein drug for administration. For another example, GDF15 can be used to treat diseases related to obesity and underweight. Therefore, the fusion protein including GDF15 may be administered to a subject in need.

Thus, depending on the biological activity or function of the bioactive proteins contained, the fusion proteins described herein may be used for the treatment and/or prevention of metabolism-related diseases, cardiovascular diseases, blood coagulation/bleeding diseases, growth disorders or conditions, tumors, vascular disorders, inflammations, and autoimmune disorders. More specifically, the diseases include type 1 diabetes, type 2 diabetes, gestational diabetes, hypercholesterolemia, obesity, hyperglycemia, hyperinsulinemia, decreased insulin production, insulin resistance, metabolic disorder, polycystic ovarian syndrome, dyslipidemia, eating disorder, hypertension (such as pulmonary hypertension), retinal neurodegeneration, metabolic disorder, glucagonoma, ulcerative colitis, renal failure, congestive heart failure, nephrotic syndrome, nephropathy, diarrhea, postoperative dumping syndrome, irritable bowel syndrome, critically ill polyneuropathy, systemic inflammatory response syndrome, dyslipidemia, stroke, coronary heart disease, hemophilia, GH deficiency in adults and children, Turner syndrome, chronic renal failure, intrauterine growth retardation, idiopathic short stature, AIDS consumption, obesity, multiple sclerosis, aging, fibromyalgia, Crohn's disease, ulcerative colitis, muscular dystrophy, and low bone density. The present disclosure includes methods for treating or preventing any of the above diseases, including administering a therapeutically effective amount or a prophylactically effective amount of a fusion protein as described herein that contains an active protein drug for the treatment or prevention of such disease.

The present disclosure further provides a method for enhancing the pharmacokinetic properties of a bioactive protein, in particular an active protein drug, the method including an operation of fusing a gelatin-like protein as described herein at the C-terminal and/or N-terminal of the bioactive protein. Herein, the pharmacokinetic properties include, but are not limited to, half-life in vivo. In some embodiments, the present disclosure further provides a method for improving the physicochemical properties of a bioactive protein, in particular an active protein drug, the method including an operation of fusing a gelatin-like protein as described herein at the C-terminal and/or N-terminal of the bioactive protein. Herein, the physicochemical properties include, but are not limited to, any one, any two, any three or all four of water solubility, serum stability, enzyme resistance stability and thermal stability. In the above method, the bioactive protein may be any one or more of the bioactive proteins described above. Methods of fusion or chemical cross-linking are known in the art. For example, the fusion protein may be prepared using the method for preparing the fusion proteins as described above, thereby enhancing the pharmacokinetic properties and/or improving the physicochemical properties of the bioactive protein.

Therefore, the present disclosure further provides the use of the gelatin-like units or gelatin-like proteins described herein in enhancing the pharmacokinetic properties and/or improving the physicochemical properties of bioactive proteins, in particular active protein drugs. The present disclosure further provides the use of the gelatin-like units or gelatin-like proteins described herein in the preparation of pharmacokinetically enhanced and/or physicochemically enhanced bioactive proteins, in particular active protein drugs. The present disclosure further provides the use of the polynucleotide sequences, nucleic acid constructs, host cells and/or fusion proteins described herein in the preparation of drugs. The present disclosure further provides gelatin-like units or gelatin-like proteins as described herein for enhancing the pharmacokinetic properties and/or improving the physicochemical properties of bioactive proteins (in particular active protein drugs), as well as fusion proteins for therapeutic or prophylactic use.

The present disclosure discovers for the first time that proteins consisting of glycine, proline, alanine and glutamic acid may serve as carrier proteins to prolong the half-life of bioactive proteins or peptides and improve their properties in vitro and in vivo. Thus, the use of glycine, proline, alanine and glutamic acid in the preparation of carrier proteins that improve the biological properties or functions (e.g., pharmacokinetic and physicochemical properties) of bioactive proteins is also included within the scope of the present disclosure. In some embodiments, the present disclosure further provides a method for preparing a carrier protein capable of improving biological properties or functions of a bioactive protein. The method may be either a chemical synthesis method or a biological recombination method. The carrier protein has a G-X-Y ternary repetitive structure, G is glycine, and X and Y are independently selected from proline, alanine and glutamic acid. More preferably, the carrier protein is the gelatin-like protein described in any of the embodiments herein.

The chemical synthesis method may be selected from various chemical synthesis methods well-known in the art, including sequentially connecting amino acid residues selected from glycine, proline, alanine and glutamic acid to a peptide chain according to the structure of the carrier protein, to form the carrier protein with a G-X-Y ternary repetitive structure. Chemical synthesis methods usually include solid-phase synthesis and liquid-phase synthesis, of which solid-phase synthesis is more commonly used. Solid-phase synthesis methods include, but are not limited to, two commonly used methods, Fmoc and tBoc. Typically, resins serve as insoluble solid-phase carriers. Amino acids are usually connected to the peptide chain one by one from the C-terminal (carboxyl end) to the N-terminal (amino end), with each amino acid connection cycle consisting of the following three reactions: 1) deprotection: the protected amino acid requires a deprotective solvent to remove the protecting group of the amino group; 2) activation: the carboxyl group of the to-be-connected amino acid is activated by an activating agent; and 3) coupling: the activated carboxyl group reacts with the naked amino group of the preceding amino acid to form a peptide bond. The cycle is repeated until the peptide chain extends to the desired length. Finally, the desired amino acid sequence is obtained by cutting the connection between the peptide chain and the solid phase carrier using the cutting solution. The above chemical synthesis can be performed on program-controlled automated polypeptide synthesizers, which include but are not limited to the Tribute two-channel polypeptide synthesizer from Protein Technologies, the UV Online Monitor system from C S Bio, and the Focus XC three-channel synthesizer from Aapptec.

The biological recombination method includes preparing a polynucleotide sequence encoding an amino acid sequence according to the amino acid sequence of the vector protein, constructing an expression vector using the polynucleotide sequence, transforming or transfecting a host cell using the expression vector, and culturing the host cell for expression to produce the carrier protein. This can be achieved using technical means well known in the art.

The following specific embodiments, unless otherwise specified, are conventional methods well known to those skilled in the art. Embodiments of the present disclosure use conventional techniques of immunology, biochemistry, microbiology, cell biology, genetics, and recombinant DNA, which may be referred to the third edition of Molecular Cloning: A Laboratory Manual (Sambrook J, Russell D W, Molecular Cloning: A Laboratory Manual. 3rd Edition, New York: Cold Spring Harkbor Laboratory Press, 2001) or a technical scheme in an operating manual provided by a commercial company.

The method of protein purification varies according to different expression systems. Existing technology already has a lot of knowledge to provide guidance on protein purification, such as Antibody Purification Handbook (GE Healthcare's classic Purification guide), or METHODS IN ENZYMOLOGY, Guide to Protein Purification, 2nd Edition (published by Elsevier press). The principles and use of purification tools such as affinity chromatography, molecular exclusion chromatography, ion-exchange chromatography and hydrophobic chromatography, as well as their combined use, are well known to those skilled in the art. The purification procedures involved in the following embodiments is exemplary to show the manner of purification under the particular fermentation condition with methanolic yeast GS115 being the expression host. When the fermentation conditions are different, the components and content of impurities are also different, therefore, the purification conditions should be slightly adjusted accordingly. Since this is a well-known technology, it will not be repeated herein. However, as a general standard, the final purity of the target protein should exceed 95% (SDS-PAGE purity and HPLC-identified purity).

Embodiment 1 Obtaining of the Gelatin-Like Protein Unit (U)

Gelatin-like units (U) are mainly composed of the following G-X-Y ternary monomer structures: GPP, GEE, GAA, GEA, GAE, GAP, GPA, GPE, and GEP. Different G-X-Y ternary monomer structures may be arbitrarily combined to form gelatin-like protein units (U). Exemplary combinations are shown in Table 2.

TABLE 2

| Codes of gelatin-like protein unit(U) | Amino acid sequence | Amino acid sequence, nucleotide sequence (SEQ ID NO) |
|---|---|---|
| $U_{07}$ | GAPGEPGPAGPPGAEGAPGPAGPEGEA | 17, 18 |
| $U_{15}$ | GAEGEPGEAGPPGAPGEAGAEGAPGPE | 19, 20 |
| $U_{38}$ | GEPGEAGPEGAPGPAGEPGAPGEAGEP | 21, 22 |
| $U_{46}$ | GPPGPAGAPGPAGEPGEAGPPGAPGPA | 23, 24 |
| $U_{58}$ | GPPGEAGAPGPEGAEGEAGEPGPAGEP | 25, 26 |
| $U_{76}$ | GPEGAPGPPGPAGEPGPAGAPGPPGEA | 27, 28 |
| $U_{77}$ | GPAGAPGEAGPPGPAGAEGEAGPAGAP | 29, 30 |
| $U_{89}$ | GEPGPEGPPGEAGAPGPPGAPGAEGEP | 31, 32 |
| $U_{100}$ | GAPGPEGAEGEAGEPGPAGEPGPEGAP | 33, 34 |
| $U_{112}$ | GPPGPAGEPGPAGAPGPPGEAGPAGAP | 35, 36 |
| $U_{125}$ | GEAGPPGPAGAEGEAGPAGAPGEPGPE | 37, 38 |
| $U_{134}$ | GPPGEAGAPGPPGAPGAEGEPGAPGEP | 39, 40 |
| $U_{139}$ | GPEGAEGEAGEPGPAGEPGPEGAPGPP | 41, 42 |
| $U_{155}$ | GPAGEPGPAGAPGPPGEAGPAGAPGEA | 43, 44 |
| $U_{167}$ | GPPGPAGAEGEAGPAGAPGEPGPEGPP | 45, 46 |
| $U_{190}$ | GEAGAPGPPGAPGAEGEPGAPGEPGPA | 47, 48 |
| $U_{211}$ | GEPGPEGAAGEEGPEGAEGPAGPAGAP | 49, 50 |
| $U_{234}$ | GAPGAEGEEGPPGEAGEPGAPGPEGAA | 51, 52 |
| $U_{239}$ | GPPGAEGEAGEAGEAGPAGEEGPPGAP | 53, 54 |
| $U_{256}$ | GPPGEAGEEGAPGAEGEAGPPGAEGPA | 55, 56 |
| $U_{261}$ | GEAGPPGEAGEAGAPGPEGAAGEPGPE | 57, 58 |
| $U_{278}$ | GEEGEAGAPGEEGPPGEAGPAGPPGAA | 59, 60 |
| $U_{285}$ | GPAGAEGEEGEPGEPGPAGAEGPPGAA | 61, 62 |
| $U_{290}$ | GPAGPEGPEGAAGAEGEEGEAGPPGPA | 63, 64 |
| $U_{299}$ | GAEGPAGPEGAPGAEGEEGPPGAEGAP | 65, 66 |
| $U_{326}$ | GPAGEEGPEGAPGAAGPPGAPGEEGEA | 67, 68 |
| $U_{327}$ | GAEGAEGAEGEPGPAGPAGPPGEEGPA | 69, 70 |
| $U_{358}$ | GEPGAPGAEGEPGPPGAPGAEGEEGAA | 71, 72 |
| $U_{379}$ | GAEGPPGPEGAEGPAGPPGEEGAAGAE | 73, 74 |
| $U_{390}$ | GEEGEPGAEGPAGPAGEAGAEGAPGPP | 75, 76 |
| $U_{431}$ | GEAGAPGEAGPAGPPGEEGPEGAPGAE | 77, 78 |
| $U_{436}$ | GPPGAAGEEGPAGAPGEPGAAGEEGPE | 79, 80 |
| $U_{463}$ | GAPGEPGAPGPEGPEGEPGAAGAEGAE | 81, 82 |
| $U_{484}$ | GAEGAAGEEGPEGAEGAPGAPGPPGEP | 83, 84 |
| $U_{495}$ | GAPGAAGEAGPPGPEGEAGEAGEEGPP | 85, 86 |
| $U_{536}$ | GAPGEPGEEGEPGAAGPPGAEGAEGPA | 87, 88 |
| $U_{568}$ | GEPGPAGPEGEEGAAGEAGPPGEAGAP | 89, 90 |

Embodiment 2 Preparation of Highly Expressed
Low-Molecular-Weight Recombinant Gelatin-Like
Protein (GS)

low-molecular-weight recombinant gelatin-like protein
(GS) may be obtained by any one of the following:

(1) first, designing a protein sequence of gelatin-like
protein (GS) consisting of different or identical gelatin-
like protein units (U); then, converting the protein
sequence of gelatin-like protein (GS) into a DNA
sequence, and obtaining a full-length DNA by gene
synthesis.

(2) splicing the nucleotide sequences corresponding to the
gelatin-like protein units (U), as shown in Marc W. T.
Werten et al. (Marc W. T. Werten et al., Secreted
production of a custom-designed, highly hydrophilic
gelatin in $Pichia$ $pastoris$, Marc W. T. Werten et al,
Protein Engineering, Design and Selection, 14:447-
454, 2001): first, obtaining the DNA sequences of the
gelatin-like protein units (U) by gene synthesis, and
then, obtaining the gelatin-like protein (GS) with
higher molecular weight by gene splicing from
repeated splicing of these gelatin-like protein units (U).
Exemplary GS sequences are shown in Table 3.

For example, a nucleotide sequence containing $U_x$, $U_y$ and
$U_z$ (referred to as $U_{xyz-1}$) is synthesized with the addition of
the a-factor signal peptide sequence of yeast GS115 (with
Xho I site) and immediately followed by the addition of
recognition site of endonuclease DraIII at the 5' end, and
with Van911 and EcoRI recognition sites at the 3' end, and
then ligated to the cloning vector pMD18-T (TaKaRa) to
construct the plasmid pMD-$U_{xyz-1}$.

To obtain a dimer of $U_{xyz-1}$, the plasmid pMD-$U_{xyz-1}$ is
first double digested with Van 91I/Dra III. Electrophoresis is
performed with 1% agarose gel and $U_{xyz-1}$ fragments are
recovered by gel cutting. Meanwhile, the pMD-$U_{xyz-1}$ plas-
mid is single digested with Van91I. The digested plasmid is
recovered by gel cutting as above, dissolved in 30 μL of TE
solution, and then treated with alkaline phosphatase (BAP).

The dephosphorylated pMD-$U_{xyz-1}$ and the $U_{xyz-1}$ frag-
ments recovered from Van 91I/Dra III double digestion are
ligated using T4DNA ligase at a molar ratio of 1:10. The
ligation products are transformed into $E.$ $coli$ DH5α receptor
cells. Monoclonal clones are selected from the transforma-
tion plates to ampicillin-resistant LB liquid medium for
culturing, and the plasmids are extracted by a conventional
method and identified by XhoI/EcoRI double digestion.
Positive clones are identified and sequenced after enzyme
digestion. The positive clones are the dimeric pMD-$U_{XYZ-2}$.
The target genes $U_{xyz-3}$ and $U_{xyz-4}$ containing three or four
$U_{xyz-1}$ fragments can be constructed by ligating the $U_{xyz-1}$ or
$U_{XYZ-2}$ fragments to pMD-$U_{XYZ-2}$.

Similarly, a nucleotide sequence containing $U_a$, $U_b$ and $U_c$
(referred to as $U_{abc-1}$) can be spliced with $U_{xyz-1}$ by the above
method to form $U_{abcxyz-1}$, which can then be spliced to
dimeric $U_{abcxyz-2}$ or spliced with gelatin-like protein units
(U) of other sequences, and so on.

Or, gelatin-like protein units (U) can be spliced through
complementary sticky ends under the action of T4DNA ligase and then subjected to agarose gel electrophoresis, to
recover DNA fragments of appropriate size, as reported by
Martin Schlapschy et al. (Martin Schlapschy et al. Fusion of
a recombinant antibody fragment with a homo-amino-acid
polymer: effects on biophysical properties and prolonged
plasma half properties and prolonged plasma half-life, Pro-
tein Engineering, Design&Selection, 20:273-284, 2007).
Similarly, the gelatin-like protein units (U) involved in
splicing may have the same sequence or different sequences.
To facilitate purification, a 6His affinity purification tag may
be added to the N-terminal or C-terminal of the gelatin-like
protein (GS).

The gelatin-like protein (GS) is fused with a 6His tag at
the N-terminal end, and the nucleotide fragment is sub-
cloned into plasmid pPIC9 (Life Technologies) to construct
an expression vector. Methylotrophic yeast $Pichia$ $pastor$
GS115 (His$^-$) serves as the expression host cell, and the
linearized expression plasmid is transformed into GS115 by
electrotransformation. Culturing at 30° C. for 3 days until
single colony appears. Inoculating a single colony of the
above-mentioned transformed recombinant yeast into 10 ml
BMGY liquid medium, culturing at 30° C. at 250 rpm for
24h, and then standing overnight. Discarding the superna-
tant, adding 10 ml of BMMY liquid medium containing 1%
methanol, and inducing expression at 30° C. at 250 rpm.
Adding 5× loading buffer to culture supernatant for mixing,
and heating at 100° C. for 8-10 min. The expression strains
are screened by SDS-PAGE electrophoresis. As a classic
theoretical guide, specific detailed steps can be found in Life
Technologies' product manual "$Pichia$ Expression Kit, For
Expression of Recombinant Proteins in $Pichia$ $pastoris$,
Catalog no. K1710-01". It is worth noting that gelatin-like
proteins (GS) stain less efficiently under conventional
Coomassie brilliant blue staining conditions and more effi-
ciently using negative staining, such as copper staining
(Chris Lee et al., Analytical Biochemistry 166:308-312,
1987). The specific operations are as follows: 1. preparing
0.3M CuCl$_2$ aqueous solution; 2, rinsing the electrophoresis
gel with double distilled water for 2-3 min after detaching
the electrophoresis gel; 3, infiltrating the gel into the 0.3M
CuCl$_2$ solution and dyeing for 2-5 minutes; 4, taking out the
gel, taking a picture with an imager.

Centrifuging the culture supernatant at 8000 rpm to
remove the sediment. Precipitating with 40% ammonium
sulfate, and then reconstituting the precipitate with deion-
ized water. The sample is loaded onto a 50 ml Chelating
Sepharose Fast Flow chromatographic column (GE Health-
care) equilibrated with equilibration buffer (0.5M NaCl, 20
mM imidazole, 20 mM Tris-HCl, pH7.5), and eluted linearly
with 10-100% elution buffer (0.15M NaCl, 0.5M imidazole,
20 mM Tris-HCl, pH8.0) after reequilibration. After mixing
the 50% eluent, adding ammonium sulfate with 35% satu-
ration to precipitate, centrifuging at 8000 rpm for 20 minutes
to collect the precipitate, and reconstituting with deionized
water.

Table 3 exemplarily lists low-molecular-weight gelatin-
like proteins (GS) consisting of gelatin-like units (U) and the
corresponding sequences.

TABLE 3

Low-molecular-weight gelatin-like proteins (GS) composed of gelatin-like units (U)

| Codes of gelatin-like proteins (GS) | Amino acid sequence, nucleotide sequence (SEQ ID NO:) | GRAVY Value | Codes of gelatin-like proteins(GS) | Amino acid sequence, nucleotide sequence (SEQ ID NO:) | GRAVY Value |
|---|---|---|---|---|---|
| GS100R9 | 91, 92 | −0.795 | GS100R35 | 93, 94 | −0.806 |
| GS100R52 | 95, 96 | −0.806 | GS100R74 | 97, 98 | −0.901 |
| GS100R77 | 99, 100 | −0.806 | GS100R98 | 101, 102 | −0.806 |
| GS100R112 | 103, 104 | −0.806 | GS100R127 | 105,106 | −0.866 |
| GS100L23 | 107, 108 | −0.793 | GS100L63 | 109, 110 | −0.478 |
| GS100L91 | 111, 112 | −0.806 | GS100L102 | 113, 114 | −0.867 |
| GS100L136 | 115, 116 | −0.867 | GS100L192 | 117, 118 | −0.278 |
| GS100L146 | 119, 120 | −0.867 | GS100L179 | 121, 122 | −0.432 |
| GS100S14 | 123, 124 | −0.795 | GS100S45 | 125, 126 | −0.120 |
| GS100S84 | 127, 128 | −0.376 | GS100S105 | 129, 130 | −0.565 |
| GS100S148 | 131, 132 | −0.001 | GS100S179 | 133, 134 | −0.775 |
| GS100S203 | 135, 136 | −0.795 | GS100S257 | 137, 138 | −0.667 |

Embodiment 3 Gelatination and Viscosity Determination

Viscosity and reversible gelatination in response to temperature in aqueous solutions are the most important properties of natural gelatin. When an aqueous solution of natural gelatin with a concentration greater than 0.5% is cooled to about 35-40° C., it first increases in viscosity and then forms a gel. The rigidity or strength of the gel depends on the gelatin concentration, the intrinsic strength of the gelatin, pH, temperature and the presence of additives (GELATIN HANDBOOK, GMIA, 2012). Animal-derived gelatin is prepared by acid or alkali hydrolysis of collagen. Those with a molecular weight distribution of 20 KD-25 KD are generally considered to have low Bloom values, those with 25-50 KD are considered to have medium Bloom values, and those with 50 KD-100 KD are considered to have are high Bloom values. When testing the gel strength, the high-expressed low-molecular-weight gelatin-like protein (GS) in Embodiment 2 is prepared into a dimer or spliced by sticking ends to make its molecular weight reach more than 40 KD, and then compared to natural animal-derived gelatin. As a comparison, GLK composed of 4-16 amino acids is prepared at the same time.

This embodiment refers to the method of the Chinese national standard "Food Additive: Gelatin" GB6783-94 to determine the gel strength and Brookfield viscosity of the samples. The GS protein purified samples in Table 4 are firstly prepared into 6.67% (W/W) aqueous solution, and then the gel strength is measured using a gel strength tester and the viscosity is measured using an ND-2 Brookfield viscosity tester. Animal gelatin (48722-100G-F, Sigma) serves as a control. Each measurement is repeated three times, and the results are shown in Table 4.

The results in Table 4 show that GS of various lengths and different sequences have no obvious natural animal gelatin properties, while the properties of rGLK116$_4$ are close to those of natural gelatin.

TABLE 4

| Codes of gelatin-like proteins (GS) | Amino acid sequence, nucleotide sequence (SEQ ID NO:) | Gel strength (Bloom g) | Viscosity (mPa · s) |
|---|---|---|---|
| GS400R9 | 139, 140 | 1.2 | 0.1 |
| GS400R35 | 141, 142 | 1.7 | 0.2 |
| GS400R52 | 143, 144 | 2.0 | 0.1 |

TABLE 4-continued

| Codes of gelatin-like proteins (GS) | Amino acid sequence, nucleotide sequence (SEQ ID NO:) | Gel strength (Bloom g) | Viscosity (mPa · s) |
|---|---|---|---|
| GS400R74 | 145, 146 | 1.5 | 0.3 |
| GS400R77 | 147, 148 | 2.3 | 0.3 |
| GS400R98 | 149,150 | 2.3 | 0.2 |
| GS400R112 | 151, 152 | 1.5 | 0.5 |
| GS400R127 | 153, 154 | 1.7 | 0.1 |
| GS400L23 | 155, 156 | 2.0 | 0.2 |
| GS400L63 | 157, 158 | 2.2 | 0.5 |
| GS400L91 | 159, 160 | 2.3 | 0.3 |
| GS400L102 | 161, 162 | 2.3 | 0.2 |
| GS400L136 | 163, 164 | 1.8 | 0.3 |
| GS400L192 | 165, 166 | 1.9 | 0.2 |
| GS400L146 | 167, 168 | 2.3 | 0.4 |
| GS400L179 | 169, 170 | 1.9 | 0.3 |
| GS400S14 | 171, 172 | 2.4 | 0.4 |
| GS400S45 | 173, 174 | 1.6 | 0.5 |
| GS400S84 | 175, 176 | 1.8 | 0.3 |
| GS400S105 | 177, 178 | 2.1 | 0.5 |
| GS400S148 | 179, 180 | 2.2 | 0.3 |
| GS400S179 | 181, 182 | 2.4 | 0.4 |
| GS400S203 | 183, 184 | 1.7 | 0.3 |
| GS400S257 | 185, 186 | 1.8 | 0.4 |
| Animal gelatin | | 176 | 18.0 |
| GLK1 (4 amino acids, GAPY) | 187, 188 | 43 | 5.1 |
| GLK2 (4 amino acids, GLPY) | 189, 190 | 47 | 4.9 |
| GLK3 (4 amino acids, GAPD) | 191, 192 | 41 | 5.3 |
| GLK4 (6 amino acids, GAPEYH) | 193, 194 | 54 | 6.2 |
| GLK5 (6 amino acids, GAPEWD) | 195, 196 | 56 | 6.7 |
| GLK6 (8 amino acids, GAPEWDYH) | 197, 198 | 68 | 7.3 |
| GLK7 (8 amino acids, GAPESKQH) | 199, 200 | 70 | 7.5 |
| GLK8 (10 amino acids, GLSQNWKRDP) | 201, 202 | 80 | 8.6 |
| GLK9 (10 amino acids, GFPVENWYDQ) | 203, 204 | 81 | 8.9 |
| GLK10 (12 amino acids, GFPVENWYDQIK) | 205, 206 | 78 | 9.4 |
| GLK11 (12 amino acids, GFSVENWYDQLT) | 207, 208 | 74 | 8.7 |
| rGLK116$_4$ | 209, 210 | 81 | 9.7 |

Embodiment 4 Expression of hArg1 Fusion Protein

Human arginase 1 (hArg1) is a natural trimeric structure. The molecular weight of its monomer is about 35 KD, and the molecular weight of its trimer is about 105 KD. Although this molecular weight is well above the glomerular filtration pore size, the half-life of human arginase 1 in vivo is surprisingly short, only a few minutes (P. N. Cheng, T. L. Lam, W. M. Lam, S. M. Tsui, A. W. Cheng, W. H. Lo, et al., Pegylated recombinant human arginase (rhArg-peg5,000 mw) inhibits the in vitro and in vivo proliferation of human hepatocellular carcinoma through arginine depletion, Cancer Res. 67(2007) 309-317). The in-vivo half-life of human arginase 1 is usually prolonged by PEGylation modification.

The spliced GS fragment and control fragment (6His purification tag introduced at the N-terminal) in Embodiment 2 are fused with human arginase 1 (SEQ ID NO:7), as shown in Table 5. The nucleotide fragment is subcloned into plasmid pPIC9 (Life Technologies) to construct an expression vector. Methylotrophic yeast *Pichia pastor* GS115 (His⁻) serves as the expression host cell, and the linearized expression plasmid is transformed into GS115 by electrotransformation. Culturing at 30° C. for 3 days until a single colony appears. Inoculating a single colony of the above-mentioned transformed recombinant yeast into 10 ml BMGY liquid medium, culturing at 30° C. at 250 rpm for 24h, and then standing overnight. Discarding the supernatant, adding 10 ml of BMMY liquid medium containing 1% methanol, and inducing expression at 30° C. at 250 rpm. Adding 5× loading buffer to culture supernatant for mixing, and heating at 100° C. for 8-10 min. The expression strains are screened by SDS-PAGE electrophoresis. As a classic theoretical guide, specific detailed steps can be found in Life Technologies' product manual "*Pichia* Expression Kit, For Expression of Recombinant Proteins in *Pichia pastoris*, Catalog no. K1710-01".

TABLE 5

| | Exemplary hArg1 fusion protein |
|---|---|
| Codes of fusion proteins | Amino acid sequence, nucleotide sequence (SEQ ID NO:) |
| GS100R9-hArg1 | 211, 212 |
| GS100R35-hArg1 | 213, 214 |
| GS100R52-hArg1 | 215, 216 |
| GS100R9-hArg1-GS100R9 | 217, 218 |
| GS100R35-hArg1-GS100R35 | 219, 220 |
| GS100R52-hArg1-GS100R52 | 221, 222 |
| GS100R74-hArg1-GS100R74 | 223, 224 |
| GS100R77-hArg1-GS100R77 | 225, 226 |
| GS100R98-hArg1-GS100R98 | 227, 228 |
| GS100R112-hArg1-GS100R112 | 229, 230 |
| GS200R9-hArg1 | 231, 232 |
| GS200R9-hArg1-GS200R9 | 233, 234 |
| GS400R9-hArg1-GS400R9 | 235, 236 |
| GS400R77-hArg1-GS400R77 | 237, 238 |
| GS500R9-hArg1 | 239, 240 |
| GLKRD-hArg1 | 241, 242 |
| rGLK1164-hArg1 | 243, 244 |
| GEE151-hArg1 | 245, 246 |

Embodiment 5 Separation and Purification of hArg1 Fusion Protein

The method of protein purification varies according to different expression systems. Existing technology already has a lot of knowledge to provide guidance on protein purification, such as Antibody Purification Handbook (GE Healthcare's classic Purification guide), or METHODS IN ENZYMOLOGY, Guide to Protein Purification, 2nd Edition (published by Elsevier press). Affinity chromatography, molecular exclusion chromatography, ion-exchange chromatography and hydrophobic chromatography are already well-known techniques to the skilled in the art. The following purification procedures are illustrative of the purification methods used when the expression host is methanolic yeast GS115 and under specific fermentation conditions. The purification conditions should be slightly adjusted accordingly when the fermentation conditions are different, which will not be repeated herein.

2L of fermentation supernatant is concentrated to 250 mL by ultrafiltration with a 30 kDa filter membrane. The concentrated solution is added with 0.5M ammonium sulfate and centrifuged to obtain the supernatant. 1.3M ammonium sulfate is added to the supernatant to centrifuge to discard the supernatant. The precipitate is redissolved with 1M ammonium sulfate, 20 mM PB (pH6.0). The sample is loaded onto a 5 mL Phenyl Bestarose High-Performance chromatographic column (Bestchrom Biotechnology Co., Ltd.) equilibrated with equilibration buffer (1M ammonium sulfate, 20 mM PB, pH 6.0), and eluted with 0-100% 20 mM PB pH6.0 buffer at 15 BV (5 mL/min, 15 min) after reequilibration. The eluent is added with $CoCl_2$ to a concentration of 50 mM in the system, activated at 60° C. for 10 min, and centrifuged to remove the precipitate. The supernatant is desalted by G25 with 20 mM NaAc-HAc pH 6.0 Buffer. After desalting, the sample with pH 6.0 is concentrated on a 1 ml SuperQ-650M chromatographic column (Tosoh BioScience) and eluted with 0-100% B at 20CV. Equilibration buffer: 20 mM NaAc-HAc (pH 6.0), elution buffer: 0.5M NaCl+20 mM NaAc-HAc (pH 6.0).

When the purity of the sample determined by SDS-PAGE is not more than 95%, the sample is loaded onto a 50 ml Chelating Sepharose Fast Flow chromatographic column (GE Healthcare) equilibrated with equilibration buffer (0.5M NaCl, 20 mM imidazole, 20 mM Tris-HCl, pH7.5), and eluted with 10%, 50%, and 100% elution buffer (0.15M NaCl, 0.5M imidazole, 20 mM Tris-HCl, pH8.0) after reequilibration.

Embodiment 6 Preparation of G-CSF Fusion Protein

The spliced GS or GLK fragment from Embodiment 2 is fused to G-CSF (SEQ ID NO:9) with the N-terminal connected to 6His (as shown in Table 6). The nucleotide fragment is subcloned into plasmid pPIC9 (Life Technologies) to construct an expression vector. Methylotrophic yeast *Pichia pastor* GS115 (His⁻) serves as the expression host cell, and the linearized expression plasmid is transformed into GS115 by electrotransformation. Culturing at 30° C. for 3 days until single colony appears. The methanol induction process is shown in Embodiment 2. Adding 5× loading buffer to culture supernatant for mixing well, and heating at 100° C. for 8-10 min. The expression strains are screened by SDS-PAGE electrophoresis. As a classic theoretical guide, specific detailed steps can be found in Life Technologies' product manual "*Pichia* Expression Kit, For Expression of Recombinant Proteins in *Pichia pastoris*, Catalog no. K1710-01".

The centrifuged supernatant of the fermentation broth is first precipitated with 40% ammonium sulfate, and then reconstituted with deionized water. The sample is loaded onto a 50 ml Chelating Sepharose Fast Flow chromatographic column (GE Healthcare) equilibrated with equilibration buffer (0.5M NaCl, 20 mM imidazole, 20 mM Tris-HCl, pH7.5), and eluted linearly with 0-100% elution buffer (0.15M NaCl, 0.5M imidazole, 20 mM Tris-HCl, pH8.0) after reequilibration. Adding ammonium sulfate with 35% saturation to precipitate the 50% eluent, centrifuging at 8000 rpm for 20 minutes to collect the precipitate, and reconstituting with deionized water.

TABLE 6

Exemplary G-CSF fusion proteins

| Codes of fusion proteins | Amino acid sequence, nucleotide sequence (SEQ ID NO:) |
|---|---|
| GS100R9-GCSF | 247, 248 |
| GS100R35-GCSF | 249, 250 |
| GS100R52-GCSF | 251, 252 |
| GS100R74-GCSF | 253, 254 |
| GS100R77-GCSF | 255, 256 |
| GS100R98-GCSF | 257, 258 |
| GS100R112-GCSF | 259, 260 |
| rGLK1164-GCSF | 261, 262 |

Embodiment 7 SEC-HPLC Analysis of GS-Arg1 Apparent Molecular Weight

The GS and hArg1 fusion protein 1 mg/ml samples and a molecular weight standard (gel filtration standard proteins, Agilent) mixed solution are analyzed by SEC-HPLC-UV. The relative molecular weight ($M_r$) serves as the abscissa, and the actually measured elution volume ($V_e$) serves as the ordinate. Linear regression: $V_e = K_1 - K_2 \log M_r$. $K_1$ and $K_2$ are constants, and $M_r$ is the relative molecular weight. Sepax SRT SEC-1000 Å 5 μm (300×7.8 mm) and Sepax SRT SEC-300 Å 5 μm (300×7.8 mm) chromatographic columns are used for detection, respectively, as follows: detection wavelength: 214 nm; column temperature 25° C.; mobile phase: 150 mM PB (pH 7.0)+5% isopropanol. flow rate: 1.0 ml/min, running time: 20 min.

The results are shown in FIGS. 1-2. From the Sepax SRT SEC-300 Å results, the apparent molecular weight of GS100R9-hArg1 is between 669 KD and 440 KD. From the Sepax SRT SEC-1000 Å results, the apparent molecular weights of GS100R9-hArg1-GS100R9 and GS100R35-hArg1-GS100R35 are already greater than 669 KD, while the apparent molecular weight of GS200R9-hArg1-GS200R9 is far greater than 669 KD.

Embodiment 8 Activity Assay of In Vitro Hydrolysis of Arginine by GS-Arg1

The to-be-tested samples of GS, hArg1 fusion protein (GS-hArg1) and hArg1 (R&D Systems, Cat: 5868-AR) are diluted to 1 μM. 45 μL of the diluted samples is mixed with 5 μL 500 mM CoCl₂ and then activated at 60° C. for 10 min. Adding 450 μL of 500 mM L-arginine (pH7.4) to 50 μL of the activated sample, mixing well and hydrolyzing at 37° C. for 15 min. Adding 20 μL sample to 2 mL of a urea nitrogen reagent mixture (Nanjing Jiancheng Bioengineering Institute), immediately placing in boiling water for an accurate water bath for 15 min, cooling with ice water for 5 min, and then measuring the OD value at 520 nm. Calculating the urea nitrogen content according to the standard curve. Kcat (s⁻¹) refers to the mole number of products produced by the catalytic decomposition of the substrate per mol enzyme per second, Kcat (s⁻¹)=urea nitrogen concentration (mmol/mL)/ [reaction time(s)×(sample concentration/dilution factor/molecular weight) (mmol/mL)]. The specific activity of an enzyme refers to the catalytic activity of arginase contained in each milligram of protein, and the specific activity=1/ MW*Kcat*60*1000.

The experimental results are shown in Table 7 below. Since each sample after the fusion of GS sequence has different molecular weight, the IU (specific activity) per unit mass (mg) varies. However, as is evident from the Kcat value, the hydrolysis activity of arginine by the fusion protein has not been reduced, but is slightly increased compared with hArg1.

TABLE 7

Hydrolysis activity of arginine by GS-Arg1 fusion protein

| Codes of fusion proteins | Kcat(s⁻¹) | Specific activity (IU/mg) |
|---|---|---|
| GS100R9-hArg1 | 177.9 | 240.0 |
| GS100R35-hArg1 | 177.5 | 243.8 |
| GS100R52-hArg1 | 174.3 | 239.4 |
| GS100R9-hArg1-GS100R9 | 167.4 | 185.2 |
| GS100R35-hArg1-GS100R35 | 169.4 | 192.9 |
| GS100R52-hArg1-GS100R52 | 167.5 | 190.7 |
| GS100R74-hArg1-GS100R74 | 165.4 | 187.8 |
| GS100R77-hArg1-GS100R77 | 164.2 | 187.0 |
| GS100R98-hArg1-GS100R98 | 160.9 | 183.2 |
| GS100R112-hArg1-GS100R112 | 169.3 | 192.8 |
| GS200R9-hArg1 | 158.6 | 176.3 |
| GS200R9-hArg1-GS200R9 | 161.1 | 132.0 |
| GS400R9-hArg1-GS400R9 | 163.9 | 88.4 |
| GS400R77-hArg1-GS400R77 | 160.6 | 90.2 |
| GS500R9-hArg1 | 160.5 | 90.2 |
| GLK_{RD}-hArg1 | 154.6 | 112.5 |
| rGLK116₄-hArg1 | 165.5 | 132.1 |
| GEE151-hArg1 | 170.0 | 202.3 |
| hArg1 | 147.8 | 256.2 |
| PBS | / | / |

Embodiment 9 Immunogenicity Test of GS-hArg1 Fusion Protein

SD rats are randomly divided into groups, each group consisting of 10 rats. The rats are immunized with proteins in Table 7 at a dose of 3 mg/kg subcutaneously, and once a week for continuous 4 weeks; a group of rats is injected with PBS as the Negative control. Blood is taken before administration. Two weeks after the last immunization, the rats are killed to collect the blood, and the blood is separated to obtain serum. The production of GS antibody in serum is detected by ELISA assay. Specifically, the ELISA plates are coated with GS-GCSF fusion proteins (100 ng/well). The serum of the immunized animals is diluted 100 times and 500 times, respectively, and then incubated at 37° C. for 2h. Finally, detecting the serum with HRP-labeled goat anti-rat secondary antibody (EarthOX, E030140-01), and reading the OD450 value. The results are shown in Table 8. GS-hArg1 fusion protein shows positive when coating with GS-hArg1 fusion protein and shows negative when coating with a protein unrelated to hArg1 (GS-GCSF fusion protein), indicating that it is hArg1 that leads to strong immunogenicity instead of GS carrier protein. rGLK116₄-hArg1 is always positive, indicating that rGLK116₄ produced strong immunogenicity in rats.

35

TABLE 8

Immunogenicity results of GS-hArg1 fusion protein

| Samples | Coated protein | | |
|---|---|---|---|
| rGLK116₄-GCSF | rGLK116₄-GCSF + | rGLK116₄ − | rGLK116₄-hArg1 + |
| GS100R9-hArg1-GS100 R9 | GS100R9-hArg1-GS100R9 + | GS100R9 − | GS100R9-GCSF + |
| GS100R35-hArg1-GS100R35 | GS100R35-hArg1-GS100R35 + | GS100R35 − | GS100R35-GCSF − |
| GS100R52-hArg1-GS100R52 | GS100R52-hArg1-GS100R52 + | GS100R52 − | GS100R52-GCSF − |
| GS100R74-hArg1-GS100R74 | GS100R74-hArg1-GS100- R74 + | GS100R74 − | GS100R74-GCSF − |
| GS100R77-hArg1-GS100R77 | GS100R77-hArg1-GS100R77 + | GS100R77 − | GS100R77-GCSF − |
| GS100R98-hArg1-GS100R98 | GS100R98-hArg1-GS100R98 + | GS100R98 − | GS100R98-GCSF − |
| GS100R112-hArg1-GS100R112 | GS100R112-hArg1-GS100R112 + | GS100112 − | GS100R112-GCSF − |
| rGLK1164-hArg1 | rGLK1164-hArg1 + | rGLK1164 − | rGLK1164-GCSF + |

+: if the OD450 value is more than twice of that before administration of the sample, it is positive;
−: if the OD450 value is less than twice of that before administration of the sample, it is negative.

Embodiment 10 Pharmacokinetic Test of Different GS-hArg1 Similar Proteins

SD rats are randomly divided into groups, each group consisting of 7 rats. The rats are injected with fusion proteins in Table 7 at a dose of 2 mg/kg subcutaneously. Blood of GS-hArg1 fusion protein administration group is collected before injection and 3 h, 8 h, 12 h, 24 h, 36h, 48h, 72h, 96h, 120h, 144h, 168h after injection. The blood is separated to obtain serum. Blood of hArg1 protein (R&D Systems, Cat: 5868-AR) administration group is collected before injection and 3h, 8h after injection.

The pharmacokinetics of the fusion protein in rats are detected by the sandwich ELISA method. Coating with 100 ng/well of hArg1 rabbit polyclonal antibody (self-made) overnight, and washing with PBST 3 times. Blocking with 5% non-fat dry milk, washing with PBST 3 times. The serum at each time point is diluted to a specified multiple, and then added into the ELISA plate at 100 µL/well. Incubating at 37° C. for 2 h, then washing with PBST 3 times. Adding biotin-labeled hArg1 rabbit polyclonal antibody (self-made), incubating at 37° C. for 2h, washing with PBST 3 times. Finally, the HRP-labeled streptavidin is diluted 50,000 times and added into the ELISA plate. Incubating for 1 h at 37° C., detecting by the conventional TMB method, and reading the OD450 value. The result is shown in FIG. 3. The GRAVY values for gelatin-like proteins (GS) shown in Table 3 range from −1.0 to 0, while the GRAVY value for GLK116₄ is-1.815, which are quite different. In addition, GEE151 in GEE151-hArg1 (SEQ ID NO:245), which consists of glycine (G) and glutamic acid (E), has an extremely low GRAVY value (−2.467), yet it is not as effective for pharmacogenesis and is even much less effective than rGLK116₄, and is extremely difficult to prepare. Similarly, GLKRD (GRAVY value of −0.785) in GLKRD-hArg1 (SEQ ID NO:241) does not have the same degree of effect as the GS protein due to not having the Gly-X-Y structure.

Embodiment 11 Glycosylation Assay

Protein samples are assayed for glycosyl content by the periodic acid Schiff base (PAS) reagent method: first, samples are loaded onto 10% SDS-PAGE, and after electrophoresis, glycosylation staining is performed using a Thermo Scientific Glycoprotein Staining Kit (Item 24562, Lot PE201610B): the acrylamide gel after electrophoresis is completely immersed in 100 ml of 50% methanol for 30 min to fix the gel; then, the gel is washed with 100 ml 3% acetic acid while shaking gently for 10 min; the gel is transferred to 25 ml of oxidation solution, shaking gently for 15 min, and then the gel is washed with 100 ml 3% acetic acid while shaking gently for 5 min. The operation is repeated twice. The gel is transferred to 25 ml of glycoprotein staining reagent (Thermo Scientific, item 24562, Lot PE201610B), shaking gently for 15 min.

The gel is transferred to 25 ml of reducing solution, shaking gently for 5 min. The gel is washed with 3% acetic acid while shaking gently for 5 min, and then washed with ultrapure water. After a purple-red band appears on the glycoprotein, the gel is stored in 3% acetic acid.

The result is shown in FIG. 4. After staining, only the positive control protein and rGLK116₄-hArg1 are stained, and the rGLK116₄-hArg1 bands are diffuse, indicating that this sample contains target proteins with different molecular weights caused by various modifications, and is therefore highly heterogeneous.

Embodiment 12 Preparation of GS-hGH Fusion Protein

Human growth hormone (hGH, SEQ ID NO:5) has a significant tendency to aggregate, and when expressed recombinantly alone, tends to produce a large number of irreversible aggregates. The spliced GS fragment from Embodiment 2 is expressed in fusion with the hGH gene (as shown in Table 9), with the N-terminal linked to 6His. The nucleotide fragment is subcloned into plasmid pPIC9 (Life Technologies) to construct an expression vector. Methylotrophic yeast Pichia pastor GS115 (His⁻) serves as the expression host cell, and the linearized expression plasmid is transformed into GS115 by electrotransformation. Culturing at 30° C. for 3 days until a single colony appears. The methanol induction process is shown in Embodiment 2. Centrifuging the fermentation broth to obtain the supernatant, adding 5× loading buffer for mixing, and heating at 100° C. for 8-10 min. The expression strains are screened by SDS-PAGE electrophoresis. As a classic theoretical guide, specific detailed steps can be found in Life Technologies' product manual "Pichia Expression Kit, For Expression of Recombinant Proteins in Pichia pastoris, Catalog no. K1710-01".

TABLE 9

GS-hGH fusion proteins

| Codes of fusion proteins | Amino acid sequence, nucleotide sequence (SEQ ID NO:) |
|---|---|
| GS800R9-GH-GS100R9 | 263, 264 |
| GS800R35-GH-GS100R35 | 265, 266 |
| GS800R127-GH-GS100R127 | 267, 268 |

TABLE 9-continued

GS-hGH fusion proteins

| Codes of fusion proteins | Amino acid sequence, nucleotide sequence (SEQ ID NO:) |
| --- | --- |
| GS800L91-GH-GS100L91 | 269, 270 |
| GS800L102-GH-GS100L102 | 271, 272 |
| GS800L146-GH-GS100L146 | 273, 274 |
| GS800S203-GH-GS100S203 | 275, 276 |

Adding ammonium sulfate to the fermentation broth supernatant until the conductivity is 180 mS/cm, and centrifuging at 8000 rpm at 10° C. for 15 min, to collect the protein precipitate. The precipitate is dissolved in 20 mM PB (pH 7.0) solution, and then precipitated with ammonium sulfate at a conductivity of 180 mS/cm. The precipitate is dissolved in 20 mM NaAc (pH5) solution and diluted with water until the conductivity is below 4 mS/cm. Purifying with Super Q-650M (TOSOH) (Buffer A: 20 mM NaAc pH5; Buffer B: 0.5M NaCl+20 mM NaAc pH5), eluting once with 20% B, 70% B, and 100% B. Taking 70% B eluted sample, adjusting the pH to 6, and adjusting the conductivity to 140 mS/cm with ammonium sulfate. The purification is carried out on a Phenyl HP (Bestchrom (Shanghai) Biotechnology Co., Ltd.) chromatographic column, and the elution is directly carried out with 50 mM PB (pH6). The eluted sample is kept at water bath at 80° C. for 30 min to inactivate the protease. After the sample temperature returns to room temperature, adjusting the pH to 4 and diluting the solution until the conductivity is below 4 mS/cm.

Finally, using Diamond SP Mustang chromatographic column (Bestchrom (Shanghai) Biotechnology Co., Ltd.) for purification (buffer A: 20 mM NaAc, pH4.0; Buffer B1: 20 mM NaAc, pH5; Buffer B2: 20 mM PB, pH7.0), eluting with B1 and B2 successively, and collecting B2 eluted samples.

When the purity of the sample is less than 95%, the following operations are performed: the eluent is loaded onto a 50 ml Chelating Sepharose Fast Flow chromatographic column (GE Healthcare) equilibrated with equilibration buffer (0.5M NaCl, 20 mM imidazole, 20 mM Tris-HCl, pH7.5), and eluted with 10%, 50%, and 100% elution buffer (0.15M NaCl, 0.5M imidazole, 20 mM Tris-HCl, pH8.0) after reequilibration.

Embodiment 13 Thermostability of GS-GH Fusion Protein

The purified GS-GH fusion protein prepared in Embodiment 12 is quantified by C18RP-HPLC, the concentration is adjusted to approximately 1.0 mg/ml, and the fusion protein is treated at room temperature and 85° C. for 30 min, respectively, then centrifuged to remove the precipitate. The supernatant is subjected to SDS-PAGE. The result is shown in FIG. 5.

Embodiment 14 SEC-HPLC Analysis of Aggregation of GS-hGH Fusion Protein Samples The samples treated at 85° C. in Embodiment 12 and molecular weight standard mixed solution are analyzed by SEC-HPLC-UV. The relative molecular weight ($M_r$) serves as the abscissa, and the actually measured elution volume ($V_e$) serves as the ordinate. Linear regression: $V_e = K_1 - K_2 \log M_r$. K1 and K2 are constants, and $M_r$ is the relative molecular weight. The detection method is as follows: detection wavelength: 280 nm; chromatographic column:

column temperature 25° C., Sepax SRT-1000 SEC 5 μm (300×7.8 mm), mobile phase: 50 mM PB, 150 mM NaCl, pH7.2; running time: 20 minutes. When there are obvious aggregates, high molecular weight peaks will appear in the SEC-HPLC spectrum. The result is shown in FIG. 6. hGH is not subjected to liquid phase analysis due to the massive aggregation and precipitation at high temperature.

Embodiment 15 In Vitro Cell Viability Detection of GS-GH Samples

Ba/f3-GHR cells are starved with IL-3 free RPMI 1640 medium (containing 5% FBS and 1 mg/mL G418) for 4-6h, then transferred to a centrifuge tube for centrifuging at 1000 RPM for 5 min. After resuspending in the above medium, the number of cells is counted. Adjusting to $2 \times 10^5$/mL, plating in a 96-well plate (100 μl per well, i.e., 20,000 cells per well). Each protein to be detected is diluted to an appropriate concentration with the above medium. Adding 10 μL of proteins to each well. After 48h of stimulation, using the MTT method for detection. The results are shown in Table 10 and FIG. 7 below.

TABLE 10

| Codes of fusion proteins | $EC_{50}$ (nM) |
| --- | --- |
| GS800R9-GH-GS100R9 | 7.2 |
| GS800R35-GH-GS100R35 | 8.2 |
| GS800R127-GH-GS100R127 | 7.6 |
| GS800L91-GH-GS100L91 | 6.1 |
| GS800L102-GH-GS100L102 | 8.8 |
| GS800L146-GH-GS100L146 | 7.5 |
| GS800S203-GH-GS100S203 | 8.8 |
| hGH | 0.69 |

Embodiment 16 Pharmacokinetic Test of Different GS-GH Similar Proteins

SD rats are randomly divided into groups, each group consisting of 10 rats. The rats are injected with different GS-GH proteins or hGH recombinant protein (Sino Biological, Cat: 16122-H07E) at a dose of 2 mg/kg subcutaneously. Blood is collected before injection and 3 h, 8h, 12 h, 24 h, 36h, 48 h, 72h, 96h, 120h, 144h, 168h after injection. The blood is separated to obtain serum. The pharmacokinetics of the GS-GH proteins in rats are detected by the sandwich ELISA method. hGH antibody (Sino Biological, Cat: 16122-R101) is added to the ELISA plate at 100 ng/well. Coating at 4° C. overnight, and washing with PBST 3 times. Blocking with 5% dry milk for 2h, washing again with PBST 3 times. The serum at each time point is diluted to a specified multiple, and then added into the ELISA plate. Incubating at 37° C. for 2 h, then washing with PBST 3 times. Adding biotin-labeled hGH polyclonal antibody (Sino Biological, Cat: 16122-T24, biotin-label is self-made), incubating at 37° C. for 2h, washing with PBST 5 times. Finally, the HRP-labeled streptavidin is diluted 50,000 times and added into the ELISA plate. Incubating for 1 h at 37° C., detecting by the conventional TMB method, and reading the OD450 value. The results are shown in Table 11 below.

TABLE 11

| Codes of fusion proteins | Half-life ($t_{1/2}$, hour) | Cmax(μg/mL) | $AUC_\infty$(μg/mL*h) |
| --- | --- | --- | --- |
| GS800R9-GH-GS100R9 | 17.2 | 2.4 | 77.9 |
| GS800R35-GH-GS100R35 | 16.8 | 2.4 | 76.5 |

TABLE 11-continued

| Codes of fusion proteins | Half-life ($t_{1/2}$, hour) | Cmax(μg/mL) | AUC$_\infty$(μg/mL*h) |
|---|---|---|---|
| GS800R127-GH-GS100R127 | 16.3 | 2.3 | 76.3 |
| GS800L91-GH-GS100L91 | 16.5 | 2.5 | 78.5 |
| GS800L102-GH-GS100L102 | 17.5 | 2.5 | 79.0 |
| GS800L146-GH-GS100L146 | 16.4 | 2.3 | 75.8 |
| GS800S203-GH-GS100S203 | 16.7 | 2.2 | 74.9 |
| hGH | 0.14 | 1.8 | 0.54 |

Embodiment 17 Preparation of GS-GDF15 Fusion Protein

The spliced GS fragment from Embodiment 2 is expressed in fusion with the GDF 15 (SEQ ID NO: 15) (as shown in Table 12), with the N-terminal linked to 6His. The nucleotide fragment is subcloned into plasmid pPIC9 (Life Technologies) to construct an expression vector. Methylotrophic yeast *Pichia pastor* GS115 (His⁻) serves as the expression host cell, and the linearized expression plasmid is transformed into GS115 by electrotransformation. Culturing at 30° C. for 3 days until a single colony appears. The methanol induction process is shown in Embodiment 2. Centrifuging the fermentation broth to obtain the supernatant, adding 5× loading buffer for mixing, and heating at 100° C. for 8-10 min. The expression strains are screened by SDS-PAGE electrophoresis. As a classic theoretical guide, specific detailed steps can be found in Life Technologies' product manual "*Pichia* Expression Kit, For Expression of Recombinant Proteins in *Pichia pastoris*, Catalog no. K1710-01".

TABLE 12

| Codes of fusion proteins | Amino acid sequence, nucleotide sequence (SEQ ID NO:) |
|---|---|
| GS200R9-GDF15 | 277, 278 |
| GS200L23-GDF15 | 279, 280 |
| GS200L136-GDF15 | 281, 282 |
| GS200S14-GDF15 | 283, 284 |
| GS400R9-GDF15 | 285, 286 |
| GS400L23-GDF15 | 287, 288 |
| GS400L136-GDF15 | 289, 290 |
| GS400S14-GDF15 | 291, 292 |
| GS600R9-GDF15 | 293, 294 |
| GS600L23-GDF15 | 295, 296 |
| GS600L136-GDF15 | 297, 298 |
| GS600S14-GDF15 | 299, 300 |

The centrifuged supernatant of the fermentation broth is first precipitated with 40% ammonium sulfate, and then reconstituted with deionized water. The sample is loaded onto a 50 ml Chelating Sepharose Fast Flow chromatographic column (GE Healthcare) equilibrated with equilibration buffer (0.5M NaCl, 20 mM imidazole, 20 mM Tris-HCl, pH7.5), and eluted linearly with 0-100% elution buffer (0.15M NaCl, 0.5M imidazole, 20 mM Tris-HCl, pH8.0) after reequilibration. Adding ammonium sulfate with 35-50% saturation to precipitate the eluent, centrifuging at 8000 rpm for 20 minutes to collect the precipitate, and reconstituting with deionized water.

The SDS-PAGE electrophoretogram of GS-GDF15 fusion protein is shown in FIG. 8.

Embodiment 18 Pharmacodynamic Study of GS-GDF15 Fusion Protein in DIO Mice 7-week-old C57BL/6J male mice are fed with high-fat diet (60% kcal from fat) for another 16 weeks (a total of 23 weeks), and the test is conducted when the body weight of the mice is approximately 55 g. Feeding conditions: 12h light/12h darkness, free food intake, single cage feeding; mice are grouped (8 mice per group) according to body weight and body weight growth curve the day before administration; at the next day, administering the drug subcutaneously. The administration is given at a dose of 30 nmol per kg of body weight, and the control group is injected with an equal volume of normal saline (PBS). The fusion protein is administered once every 4 days for 28 consecutive days. The body weight and food intake of mice are measured every day. Killing the mice on the 5th day after the last administration. Blood is taken from the eye socket and plasma samples are stored at −80° C. Calculating the average in body weight change and food intake change of each group of the animals before administration and at the time of killing. The results are shown in FIGS. 9-10.

Embodiment 19 Preparation of Fusion Protein of GS and GLP-2 Analog

The spliced GS fragment in Embodiment 2 is fused with Glucagon-like Peptide-2 analog GLP-2G (SEQ ID NO:1) (as shown in Table 13). The C-terminal is connected to the 6His tag, and the nucleotide fragment is subcloned into plasmid pPIC9 (Life Technologies) to construct an expression vector. Methylotrophic yeast *Pichia pastor* GS115 (His⁻) serves as the expression host cell, and the linearized expression plasmid is transformed into GS115 by electrotransformation. Culturing at 30° C. for 3 days until a single colony appears. Inoculating a single colony of the above-mentioned transformed recombinant yeast into 10 ml BMGY liquid medium, culturing at 30° C. at 250 rpm for 24h, and then standing overnight. Discarding the supernatant, adding 10 ml of BMMY liquid medium containing 1% methanol, and inducing expression at 30° C. at 250 rpm. Centrifuging the culture solution to obtain the supernatant, adding 5* loading buffer for mixing, and heating at 100° C. for 8-10 min. The expression strains are screened by SDS-PAGE electrophoresis.

TABLE 13

| Codes of fusion proteins | Amino acid sequence, nucleotide sequence (SEQ ID NO:) |
|---|---|
| GLP2G-GS800R9 | 301, 302 |
| GLP2G-GS800S14 | 303, 304 |
| GLP2G-GS800S203 | 305, 306 |

The centrifuged supernatant of the fermentation broth is first precipitated with 40% ammonium sulfate, and then reconstituted with deionized water. The sample is loaded onto a 50 ml Chelating Sepharose Fast Flow chromatographic column (GE Healthcare) equilibrated with equilibration buffer (0.5M NaCl, 20 mM imidazole, 20 mM Tris-HCl, pH7.5), and eluted with 10%, 50%, and 100% elution buffer (0.15M NaCl, 0.5M imidazole, 20 mM Tris-HCl, pH8.0) after reequilibration. After mixing the eluent, adding ammonium sulfate with 30-50% saturation to precipitate, centrifuging at 8000 rpm for 20 minutes to collect the precipitate, and reconstituting with deionized water.

Embodiment 20 Activity Assay of the Fusion Protein of GS and GLP-2G

The in vitro cytological activity of GLP-2G fusion protein is detected by the luciferase reporter gene detection method.

The GLP-2R gene is cloned into mammalian cell expression plasmid pCDNA3.1 to construct a recombinant expression plasmid pCDNA3.1-GLP-2R. The full-length luciferase gene is cloned into a pCRE-EGFP (preserved in this experiment) plasmid, and the EGFP gene is replaced to obtain a pCRE-Luc recombinant plasmid. CHO cells are transfected with pCDNA3.1-GLP-2R and pCRE-Luc plasmids at a molar ratio of 1:10, and stably transfected expression strains are screened to obtain recombinant GLP-2R/Luc-CHO stably transfected strains.

Culturing the cells in a 10-cm cell culture dish using DMEM/F12 medium containing 10% FBS and 300 μg/ml G418. When the confluence reaches about 90%, discarding the supernatant. After adding 2 ml trypsin and digesting for 2 min, adding 2 ml DMEM/F12 medium containing 10% FBS and 300 μg/ml G418 for neutralizing, transferring to a 15 ml centrifuge tube, centrifuging at 800 rpm for 5 min, discarding the supernatant, adding 2 ml DMEM/F12 medium containing 10% FBS and 300 μg/ml G418 for resuspending, counting. Diluting the cells to $3 \times 10^5$/mL with DMEM/F12 medium containing 10% FBS. Plating 100 μL in each well of a 96-well plate, i.e., 3*104 cells per well. After adherence, culturing in DMEM/F12 medium containing 0.1% FBS overnight.

After discarding the supernatant of the cells plated in the 96-well plate, the purified recombinant protein or GLP-2 (Hangzhou Chinese Peptide Biochemical Co., Ltd., Cat. No: GLUC-002A) is diluted to a series of specified concentrations with DMEM/F12 medium containing 0.1% FBS, and added to the cell culture wells (100 μL/well). Testing after stimulating for 6 h. The detection is carried out according to the instructions of luciferase reporter kit (Ray Biotech, Cat: 68-LuciR-S200). The results are shown in Table 14 and FIG. 11.

TABLE 14

| Codes of fusion proteins | $EC_{50}$(nM) |
| --- | --- |
| GLP2G-GS800R9 | 269.9 |
| GLP2G-GS800S14 | 293.2 |
| GLP2G-GS800S203 | 315.6 |
| GLP-2 | 4.7 |

Embodiment 21 Pharmacokinetic Test of GS-GLP2G Fusion Protein

SD rats are randomly divided into groups, each group consisting of 10 rats. The rats are injected with different fusion proteins at a dose of 2 mg/kg subcutaneously. Blood is collected before injection and 3 h, 8 h, 12 h, 24 h, 36h, 48 h, 72h, 96h, 120h, 144h, 168h after injection. The blood is separated to obtain serum. The pharmacokinetics of the fusion protein in rats are detected by sandwich ELISA. GLP-2 antibody (Abcam, Cat. No: ab14183) is added to the ELISA plate at 100 ng/well. Coating at 4° C. overnight, and washing with PBST 3 times. Blocking with 5% dry milk for 2h, washing again with PBST 3 times. The serum at each time point is diluted to a specified multiple, and then added into the ELISA plate. Incubating at 37° C. for 2 h, then washing with PBST 3 times. Adding biotin-labeled GLP-2 polyclonal antibody (Abcam, Cat. No: ab48292), incubating at 37° C. for 2h, washing with PBST 5 times. Finally, the HRP-labeled streptavidin is diluted 50,000 times and added into the ELISA plate. Incubating for 1 h at 37° C., detecting by the conventional TMB method, and reading the OD450 value.

TABLE 15

| Codes of fusion proteins | Half-life ($t_{1/2}$, hour) | Cmax(μg/mL) | $AUC_\infty$(μg/mL*h) |
| --- | --- | --- | --- |
| GLP2G-GS800R9 | 41.5 | 7.1 | 550.2 |
| GLP2G-GS800S14 | 42.8 | 7.0 | 545.7 |
| GLP2G-GS800S203 | 45.2 | 7.3 | 589.4 |

Embodiment 22 Preparation of GS-AR$_{VEGF}$ Fusion Protein

The spliced GS fragment in Embodiment 2 is fused with an ankyrin repeat protein binding to VEGF (ankyrin repeat proteins, SEQ ID NO:3) (as shown in Table 16). The C-terminal is connected to the 6His tag, and the nucleotide fragment is subcloned into plasmid pPIC9 (Life Technologies) to construct an expression vector. Methylotrophic yeast *Pichia pastor* GS115 (His⁻) serves as the expression host cell, and the linearized expression plasmid is transformed into GS115 by electrotransformation. Culturing at 30° C. for 3 days until single colony appears. Inoculating a single colony of the above-mentioned transformed recombinant yeast into 10 ml BMGY liquid medium, culturing at 30° C. at 250 rpm for 24h, and then standing overnight. Discarding the supernatant, adding 10 ml of BMMY liquid medium containing 1% methanol, and inducing expression at 30° C. at 250 rpm. Adding 5× loading buffer to culture supernatant for mixing well, and heating at 100° C. for 8-10 min. The expression strains are screened by SDS-PAGE electrophoresis. The fermentation broth is first heated at 80° C. for 20 min, and then centrifuged to precipitate the impurity proteins. The centrifuged supernatant of the fermentation broth is first precipitated with 40% ammonium sulfate, and then reconstituted with deionized water. The sample is loaded onto a 50 ml Chelating Sepharose Fast Flow chromatographic column (GE Healthcare) equilibrated with equilibration buffer (0.5M NaCl, 20 mM imidazole, 20 mM Tris-HCl, pH7.5), and eluted linearly with 0-100% elution buffer (0.15M NaCl, 0.5M imidazole, 20 mM Tris-HCl, pH8.0) after reequilibration. Adding ammonium sulfate with 35-50% saturation to precipitate the eluent, centrifuging at 8000 rpm for 20 minutes to collect the precipitate, and reconstituting with deionized water.

TABLE 16

| Codes of fusion proteins | Amino acid sequence, nucleotide sequence (SEQ ID NO:) |
| --- | --- |
| GS600R9-ARVEGF | 307, 308 |
| GS900R9-ARVEGF | 309, 310 |

Embodiment 23 Affinity Detection of GS-AR$_{VEGF}$ Fusion Protein

The binding affinity of the fusion protein is detected using BLI (Bio-layer inteferometry, ForteBio). First, Biotin (Thermo, Prod #21338, Sulfo-NHS) and VEGF are mixed at a molar ratio of 2:1 for labeling. Biotin not involved in labeling is removed by dialysis. Then, according to the instructions of Octet-QK, selecting a high-sensitivity experimental program, and loading the biotin-labeled VEGF on the avidin probe SA (forteBIO, Part #18-5019). The buffer used in the experiment is PBS (containing 0.1% Tween-20). The fusion protein and the control antibody diluted in gradients are added to the predetermined position of the 96-well black plate (Greiner, 655209) according to the settings of the program. Based on the program settings, the fusion protein is bound, and then dissociated in PBST solution, to obtain the experimental curve. According to the result analysis software of Octet-QK, local full is used to fit the curve of the experimental results, to calculate kon, kdis and Kd.

Table 17 summarizes the Kd of the fusion protein and the control drug Bevacizumab. It can be seen from the table that there is no significant difference in the average affinity of $AR_{VEGF}$ to VEGF before and after the fusion of GS, which is in the same order of magnitude as Bevacizumab (Medchemexpress, Cat. No.: HY-P9906).

TABLE 17

Dissociation equilibrium constant (Kd) of GS-AR$_{VEGF}$ fusion protein

| | $K_d$(nM) | | | | |
|---|---|---|---|---|---|
| Samples | Repeat 1 | Repeat 2 | Repeat 3 | Average value | STD |
| GS600R9-AR$_{VEGF}$ | 0.61 | 0.55 | 0.50 | 0.55 | 0.06 |
| GS900R9-AR$_{VEGF}$ | 0.75 | 0.64 | 0.67 | 0.69 | 0.06 |
| AR$_{VEGF}$ | 0.55 | 0.47 | 0.59 | 0.54 | 0.06 |
| Bevacizumab | 0.39 | 0.45 | 0.48 | 0.44 | 0.05 |

Embodiment 24 In Vitro Activity of GS-AR$_{VEGF}$ Fusion Protein

The activity of $AR_{VEGF}$ is measured by VEGF receptor competitive inhibition method. Adding 5 μg/mL VEGF Receptor 2/KDR (Abcam, ab 155628) to the ELISA plate, 50 μL per well, and placing the ELISA plate at 37° C. for 2h. Blocking the ELISA plate with 1% BSA/TBS and placing at 37° C. for 2 h. The $AR_{VEGF}$ and the reference substance Bevacizumab are diluted with PBST in a 3-fold gradient. 80 μL of the diluted sample is mixed with an equal volume of 1 μg/mL VEGF and placed at 37° C. for 1 h. The KDR-coated ELISA plate is washed twice and pat-dried. Then, the gradiently diluted mixture samples are successively transferred to the ELISA plate and placed at 37° C. for 1 h, then the plate is washed 5 times. Mouse anti-human VEGF monoclonal antibody (Sigma, V4758-0.5 mg) diluted at 1:1000 is added to the wells in the ELISA plate, 50 μL per well. The plate is placed at 37° C. for 1 h and washed 5 times. Then, the HRP-labeled goat anti-rat secondary antibody (Pierce, 31432, QA1969921) diluted at 1:1000 is added, 50 μL per well. The plate is placed at 37° C. for 1 h and washed for 6 times. After the reaction, adding the color developing solution, and developing the color at 37° C. for 15 min. Adding the stop buffer to terminate the color reaction. Reading the OD450 value on the microplate reader. The results are shown in Table 18 and FIG. 12.

TABLE 18

IC50 of GS-ARVEGF fusion protein

| Protein samples | IC50(nM) |
|---|---|
| GS600R9-AR$_{VEGF}$ | 0.59 |
| GS900R9-AR$_{VEGF}$ | 0.59 |
| AR$_{VEGF}$ | 0.64 |
| Bevacizumab | 0.55 |

Embodiment 25 Serum Stability

GS-GH fusion protein samples are prepared into 2.0-3.0 mg/ml with 40 mM PB (pH7.4). After the sterilization and filtration (0.22 μm, Millipore), the samples are diluted 10 times with rat serum, mixed well, and divided into sterile centrifuge tubes. The samples are placed in a 37° C. incubator. Samples on day 0 and day 7 are taken for Western-blot analysis. HRP-labeled Anti-6X His Tag® antibody (AB-CAM, AB1187) is used as the detection antibody. The result is shown in FIG. 13.

Embodiment 26 Enzyme Resistance Stability

Weighing an appropriate amount of trypsin (Sangon Biotech (Shanghai) Co., Ltd., Cat. No: A620627-0250), and dissolving the trypsin in a high-temperature sterilized 20 mM PB (containing 0.15M NaCl, pH7.5) buffer into a solution with a mass concentration of 10%. The GS-GH fusion protein (5 mg/ml) and hGH (Sino Biological, Cat: 16122-H07E, prepared into 1 mg/ml) are mixed with the trypsin solution with a final mass concentration of 0%, 0.02%, 0.1%, and 0.5% respectively. Filling up the volume with 20 mM PB (containing 0.15M NaCl, pH7.5). Then, incubating at 37° C. for 40 min; taking out, adding electrophoresis buffer and boiling for 10 min to stop the reaction. hGH samples in 0%, 0.02%, 0.1% and 0.5% trypsin-treated groups are loaded onto a 12% SDS-PAGE. GS-GH fusion proteins in 0% and 0.5% trypsin-treated groups are loaded onto an 8% SDS-PAGE. As shown in FIG. 14, hGH treated with 0.02% trypsin has almost no intact protein, while the GS-GH fusion protein has almost no degradation.

The above-mentioned embodiments are merely illustrative of the principle and effects of the present disclosure instead of limiting the present disclosure. Modifications or variations of the above-described embodiments may be made by those skilled in the art without departing from the spirit and scope of the disclosure. Therefore, all equivalent modifications or changes made by those who have common knowledge in the art without departing from the spirit and technical concept disclosed by the present disclosure shall be still covered by the claims of the present disclosure.

SEQUENCE LISTING (310 sequences)

SEQ ID NO: 1 - protein, 33 aa, Artificial Sequence
  amino acid sequence of GLP-2 analog
HGDGSFSDEMNTILDNLAARDFINWLIQTKITD

SEQ ID NO: 2 - protein, 29 aa, Artificial Sequence
  amino acid sequence of Glucagon
HSQGTFTSDYSKYLDSRRAQDFVQWLMNT

SEQ ID NO: 3 - protein, 126 aa, Artificial Sequence
  amino acid sequence of ARVEGF
GSDLDKKLLEAARAGQDDEVRILMANGADVNARDSTGWTPLHLAAPWGHPEIVEVLLKNGADVNAADFQGWTPLHLAAAVGHLEIVEVLLKYGADVNAQDKFGKTAFDISIDNGNEDLAEILQKAA

SEQ ID NO: 4 - protein, 133 aa, Artificial Sequence [sequence omitted]

SEQ ID NO: 5 - protein, 191 aa, Artificial Sequence [sequence omitted]

SEQ ID NO: 6 - protein, 114 aa, Artificial Sequence
  amino acid sequence of IL-15
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 7 - protein, 321 aa, Artificial Sequence
  amino acid sequence of Arginase 1
SAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 8 - protein, 216 aa, Artificial Sequence
  amino acid sequence of FGF19
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 9 - protein, 174 aa, Artificial Sequence
  amino acid sequence of G-CSF
TPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 10 - protein, 165 aa, Artificial Sequence
  amino acid sequence of EPO
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQEAISPPDAASAAPLRTITADTFRKLFRVYSNFLRGKLKLYTGEACRTGDR

SEQ ID NO: 11 - protein, 39 aa, Artificial Sequence
  amino acid sequence of Exendin-4
HGEGTFTSDLSKQMEEEAVRLFIEWLKNGGPSSGAPPPS

SEQ ID NO: 12 - protein, 184 aa, Artificial Sequence
  amino acid sequence of IL-6
PVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 13 - protein, 31 aa, Artificial Sequence
  amino acid sequence of GLP-1 analog
HGEGTFTSDVSSYLEEQAAKEFIAWLVKGGG

SEQ ID NO: 14 - protein, 151 aa, Artificial Sequence [sequence omitted]

SEQ ID NO: 15 - protein, 112 aa, Artificial Sequence
  amino acid sequence of GDF15
ARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 16 - protein, 181 aa, Artificial Sequence
  amino acid sequence of FGF-21
HPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 17 - protein, 27 aa, Artificial Sequence
  amino acid sequence of U07
GAPGEPGPAGPPGAEGAPGPAGPEGEA

SEQ ID NO: 18 - DNA, 81 bp, Artificial Sequence
  nucleotide sequence of U07
ggtgctccaggtgaaccaggtccagctggtccaccaggtgctgaaggtgctccaggtccagctggtccagaaggtgaagct

SEQ ID NO: 19 - protein, 27 aa, Artificial Sequence
  amino acid sequence of U15
GAEGEPGEAGPPGAPGEAGAEGAPGPE

SEQ ID NO: 20 - DNA, 81 bp, Artificial Sequence
  nucleotide sequence of U15
ggtgctgaaggtgaaccaggtgaagctggtccaccaggtgctccaggtgaagctggtgctgaaggtgctccaggtccagaa

SEQ ID NO: 21 - protein, 27 aa, Artificial Sequence
  amino acid sequence of U38
GEPGEAGPEGAPGPAGEPGAPGEAGEP

SEQ ID NO: 22 - DNA, 81 bp, Artificial Sequence
  nucleotide sequence of U38
ggtgaaccaggtgaagctggtccagaaggtgctccaggtccagctggtgaaccaggtgctccaggtgaagctggtgaacca

SEQ ID NO: 23 - protein, 27 aa, Artificial Sequence
  amino acid sequence of U46
GPPGPAGAPGPAGEPGEAGPPGAPGPA

SEQ ID NO: 24 - DNA, 81 bp, Artificial Sequence
  nucleotide sequence of U46
ggtccaccaggtccagctggtgctccaggtccagctggtgaaccaggtgaagctggtccaccaggtgctccaggtccagct

SEQ ID NO: 25 - protein, 27 aa, Artificial Sequence
  amino acid sequence of U58
GPPGEAGAPGPEGAEGEAGEPGPAGEP

SEQ ID NO: 26 - DNA, 81 bp, Artificial Sequence
  nucleotide sequence of U58
ggtccaccaggtgaagctggtgctccaggtccagaaggtgctgaaggtgaagctggtgaaccaggtccagctggtgaacca

SEQ ID NO: 27 - protein, 27 aa, Artificial Sequence
  amino acid sequence of U76
GPEGAPGPPGPAGEPGPAGAPGPPGEA

SEQ ID NO: 28 - DNA, 81 bp, Artificial Sequence
  nucleotide sequence of U76
ggtccagaaggtgctccaggtccaccaggtccagctggtgaaccaggtccagctggtgctccaggtccaccaggtgaagct

SEQ ID NO: 29 - protein, 27 aa, Artificial Sequence
  amino acid sequence of U77
GPAGAPGEAGPPGPAGAEGEAGPAGAP

SEQ ID NO: 30 - DNA, 81 bp, Artificial Sequence
  nucleotide sequence of U77
ggtccagctggtgctccaggtgaagctggtccaccaggtccagctggtgctgaaggtgaagctggtccagctggtgctcca

SEQ ID NO: 31 - protein, 27 aa, Artificial Sequence
  amino acid sequence of U89
GEPGPEGPPGEAGAPGPPGAPGAEGEP

SEQ ID NO: 32 - DNA, 81 bp, Artificial Sequence
  nucleotide sequence of U89
ggtgaaccaggtccagaaggtccaccaggtgaagctggtgctccaggtccaccaggtgctccaggtgctgaaggtgaacca

SEQ ID NO: 33 - protein, 27 aa, Artificial Sequence
  amino acid sequence of U100
GAPGPEGAEGEAGEPGPAGEPGPEGAP

SEQ ID NO: 34 - DNA, 81 bp, Artificial Sequence
  nucleotide sequence of U100
ggtgctccaggtccagaaggtgctgaaggtgaagctggtgaaccaggtccagctggtgaaccaggtccagaaggtgctcca

SEQ ID NO: 35 - protein, 27 aa, Artificial Sequence
  amino acid sequence of U112
GPPGPAGEPGPAGAPGPPGEAGPAGAP

SEQ ID NO: 36 - DNA, 81 bp, Artificial Sequence
  nucleotide sequence of U112
ggtccaccaggtccagctggtgaaccaggtccagctggtgctccaggtccaccaggtgaagctggtccagctggtgctcca

SEQ ID NO: 37 - protein, 27 aa, Artificial Sequence
  amino acid sequence of U125
GEAGPPGPAGAEGEAGPAGAPGEPGPE

SEQ ID NO: 38 - DNA, 81 bp, Artificial Sequence
  nucleotide sequence of U125
ggtgaagctggtccaccaggtccagctggtgctgaaggtgaagctggtccagctggtgctccaggtgaaccaggtccagaa

SEQ ID NO: 39 - protein, 27 aa, Artificial Sequence
  amino acid sequence of U134
GPPGEAGAPGPPGAPGAEGEPGAPGEP

SEQ ID NO: 40 - DNA, 81 bp, Artificial Sequence
  nucleotide sequence of U134
ggtccaccaggtgaagctggtgctccaggtccaccaggtgctccaggtgctgaaggtgaaccaggtgctccaggtgaacca

SEQ ID NO: 41 - protein, 27 aa, Artificial Sequence
  amino acid sequence of U139
GPEGAEGEAGEPGPAGEPGPEGAPGPP

SEQ ID NO: 42 - DNA, 81 bp, Artificial Sequence
  nucleotide sequence of U139
ggtccagaaggtgctgaaggtgaagctggtgaaccaggtccagctggtgaaccaggtccagaaggtgctccaggtccacca

SEQ ID NO: 43 - protein, 27 aa, Artificial Sequence
  amino acid sequence of U155
GPAGEPGPAGAPGPPGEAGPAGAPGEA

SEQ ID NO: 44 - DNA, 81 bp, Artificial Sequence
  nucleotide sequence of U155
ggtccagctggtgaaccaggtccagctggtgctccaggtccaccaggtgaagctggtccagctggtgctccaggtgaagct

SEQ ID NO: 45 - protein, 27 aa, Artificial Sequence
  amino acid sequence of U167
GPPGPAGAEGEAGPAGAPGEPGPEGPP

SEQ ID NO: 46 - DNA, 81 bp, Artificial Sequence
  nucleotide sequence of U167
ggtccaccaggtccagctggtgctgaaggtgaagctggtccagctggtgctccaggtgaaccaggtccagaaggtccacca

SEQ ID NO: 47 - protein, 27 aa, Artificial Sequence
  amino acid sequence of U190
GEAGAPGPPGAPGAEGEPGAPGEPGPA

SEQ ID NO: 48 - DNA, 81 bp, Artificial Sequence
  nucleotide sequence of U190
ggtgaagctggtgctccaggtccaccaggtgctccaggtgctgaaggtgaaccaggtgctccaggtgaaccaggtccagct

SEQ ID NO: 49 - protein, 27 aa, Artificial Sequence
  amino acid sequence of U211
GEPGPEGAAGEEGPEGAEGPAGPAGAP

SEQ ID NO: 50 - DNA, 81 bp, Artificial Sequence
  nucleotide sequence of U211
ggtgaaccaggtccagaaggtgctgctggtgaagaaggtccagaaggtgctgaaggtccagctggtccagctggtgctcca

SEQ ID NO: 51 - protein, 27 aa, Artificial Sequence
  amino acid sequence of U234
GAPGAEGEEGPPGEAGEPGAPGPEGAA

SEQ ID NO: 52 - DNA, 81 bp, Artificial Sequence
  nucleotide sequence of U234
ggtgctccaggtgctgaaggtgaagaaggtccaccaggtgaagctggtgaaccaggtgctccaggtccagaaggtgctgct

SEQ ID NO: 53 - protein, 27 aa, Artificial Sequence
  amino acid sequence of U239
GPPGAEGEAGEAGEAGPAGEEGPPGAP

SEQ ID NO: 54 - DNA, 81 bp, Artificial Sequence
  nucleotide sequence of U239
ggtccaccaggtgctgaaggtgaagctggtgaagctggtgaagctggtccagctggtgaagaaggtccaccaggtgctcca

SEQ ID NO: 55 - protein, 27 aa, Artificial Sequence
  amino acid sequence of U256
GPPGEAGEEGAPGAEGEAGPPGAEGPA

SEQ ID NO: 56 - DNA, 81 bp, Artificial Sequence
  nucleotide sequence of U256
ggtccaccaggtgaagctggtgaagaaggtgctccaggtgctgaaggtgaagctggtccaccaggtgctgaaggtccagct

SEQ ID NO: 57 - protein, 27 aa, Artificial Sequence
  amino acid sequence of U261
GEAGPPGEAGEAGAPGPEGAAGEPGPE

SEQ ID NO: 58 - DNA, 81 bp, Artificial Sequence
  nucleotide sequence of U261
ggtgaagctggtccaccaggtgaagctggtgaagctggtgctccaggtccagaaggtgctgctggtgaaccaggtccagaa

SEQ ID NO: 59 - protein, 27 aa, Artificial Sequence
  amino acid sequence of U278
GEEGEAGAPGEEGPPGEAGPAGPPGAA

SEQ ID NO: 60 - DNA, 81 bp, Artificial Sequence
  nucleotide sequence of U278
ggtgaagaaggtgaagctggtgctccaggtgaagaaggtccaccaggtgaagctggtccagctggtccaccaggtgctgct

SEQ ID NO: 61 - protein, 27 aa, Artificial Sequence
  amino acid sequence of U285
GPAGAEGEEGEPGEPGPAGAEGPPGAA

SEQ ID NO: 62 - DNA, 81 bp, Artificial Sequence
  nucleotide sequence of U285
ggtccagctggtgctgaaggtgaagaaggtgaaccaggtgaaccaggtccagctggtgctgaaggtccaccaggtgctgct

SEQ ID NO: 63 - protein, 27 aa, Artificial Sequence
  amino acid sequence of U290
GPAGPEGPEGAAGAEGEEGEAGPPGPA

SEQ ID NO: 64 - DNA, 81 bp, Artificial Sequence
  nucleotide sequence of U290
ggtccagctggtccagaaggtccagaaggtgctgctggtgctgaaggtgaagaaggtgaagctggtccaccaggtccagct

SEQ ID NO: 65 - protein, 27 aa, Artificial Sequence
  amino acid sequence of U299
GAEGPAGPEGAPGAEGEEGPPGAEGAP

SEQ ID NO: 66 - DNA, 81 bp, Artificial Sequence
  nucleotide sequence of U299
ggtgctgaaggtccagctggtccagaaggtgctccaggtgctgaaggtgaagaaggtccaccaggtgctgaaggtgctcca

SEQ ID NO: 67 - protein, 27 aa, Artificial Sequence
  amino acid sequence of U326
GPAGEEGPEGAPGAAGPPGAPGEEGEA

SEQ ID NO: 68 - DNA, 81 bp, Artificial Sequence
  nucleotide sequence of U326
ggtccagctggtgaagaaggtccagaaggtgctccaggtgctgctggtccaccaggtgctccaggtgaagaaggtgaagct

SEQ ID NO: 69 - protein, 27 aa, Artificial Sequence
  amino acid sequence of U327
GAEGAEGAEGEPGPAGPAGPPGEEGPA

SEQ ID NO: 70 - DNA, 81 bp, Artificial Sequence
  nucleotide sequence of U327
ggtgctgaaggtgctgaaggtgctgaaggtgaaccaggtccagctggtccagctggtccaccaggtgaagaaggtccagct

SEQ ID NO: 71 - protein, 27 aa, Artificial Sequence
  amino acid sequence of U358
GEPGAPGAEGEPGPPGAPGAEGEEGAA

SEQ ID NO: 72 - DNA, 81 bp, Artificial Sequence
  nucleotide sequence of U358
ggtgaaccaggtgctccaggtgctgaaggtgaaccaggtccaccaggtgctccaggtgctgaaggtgaagaaggtgctgct

SEQ ID NO: 73 - protein, 27 aa, Artificial Sequence
  amino acid sequence of U379
GAEGPPGPEGAEGPAGPPGEEGAAGAE

SEQ ID NO: 74 - DNA, 81 bp, Artificial Sequence
  nucleotide sequence of U379
ggtgctgaaggtccaccaggtccagaaggtgctgaaggtccagctggtccaccaggtgaagaaggtgctgctggtgctgaa

SEQ ID NO: 75 - protein, 27 aa, Artificial Sequence
  amino acid sequence of U390
GEEGEPGAEGPAGPAGEAGAEGAPGPP

SEQ ID NO: 76 - DNA, 81 bp, Artificial Sequence
  nucleotide sequence of U390
ggtgaagaaggtgaaccaggtgctgaaggtccagctggtccagctggtgaagctggtgctgaaggtgctccaggtccacca

SEQ ID NO: 77 - protein, 27 aa, Artificial Sequence
  amino acid sequence of U431
GEAGAPGEAGPAGPPGEEGPEGAPGAE

SEQ ID NO: 78 - DNA, 81 bp, Artificial Sequence
  nucleotide sequence of U431
ggtgaagctggtgctccaggtgaagctggtccagctggtccaccaggtgaagaaggtccagaaggtgctccaggtgctgaa

SEQ ID NO: 79 - protein, 27 aa, Artificial Sequence
  amino acid sequence of U436
GPPGAAGEEGPAGAPGEPGAAGEEGPE

SEQ ID NO: 80 - DNA, 81 bp, Artificial Sequence
  nucleotide sequence of U436
ggtccaccaggtgctgctggtgaagaaggtccagctggtgctccaggtgaaccaggtgctgctggtgaagaaggtccagaa

SEQ ID NO: 81 - protein, 27 aa, Artificial Sequence
  amino acid sequence of U463
GAPGEPGAPGPEGPEGEPGAAGAEGAE

SEQ ID NO: 82 - DNA, 81 bp, Artificial Sequence
  nucleotide sequence of U463
ggtgctccaggtgaaccaggtgctccaggtccagaaggtccagaaggtgaaccaggtgctgctggtgctgaaggtgctgaa

SEQ ID NO: 83 - protein, 27 aa, Artificial Sequence
  amino acid sequence of U484
GAEGAAGEEGPEGAEGAPGAPGPPGEP

SEQ ID NO: 84 - DNA, 81 bp, Artificial Sequence
  nucleotide sequence of U484
ggtgctgaaggtgctgctggtgaagaaggtccagaaggtgctgaaggtgctccaggtgctccaggtccaccaggtgaacca

SEQ ID NO: 85 - protein, 27 aa, Artificial Sequence
  amino acid sequence of U495
GAPGAAGEAGPPGPEGEAGEAGEEGPP

SEQ ID NO: 86 - DNA, 81 bp, Artificial Sequence
  nucleotide sequence of U495
ggtgctccaggtgctgctggtgaagctggtccaccaggtccagaaggtgaagctggtgaagctggtgaagaaggtccacca

SEQ ID NO: 87 - protein, 27 aa, Artificial Sequence
  amino acid sequence of U536
GAPGEPGEEGEPGAAGPPGAEGAEGPA

SEQ ID NO: 88 - DNA, 81 bp, Artificial Sequence
  nucleotide sequence of U536
ggtgctccaggtgaaccaggtgaagaaggtgaaccaggtgctgctggtccaccaggtgctgaaggtgctgaaggtccagct

SEQ ID NO: 89 - protein, 27 aa, Artificial Sequence
  amino acid sequence of U568
GEPGPAGPEGEEGAAGEAGPPGEAGAP

SEQ ID NO: 90 - DNA, 81 bp, Artificial Sequence
  nucleotide sequence of U568
ggtgaaccaggtccagctggtccagaaggtgaagaaggtgctgctggtgaagctggtccaccaggtgaagctggtgctcca

SEQ ID NO: 91 - protein, 117 aa, Artificial Sequence
  amino acid sequence of GS100R9
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 92 - DNA, 351 bp, Artificial Sequence
  nucleotide sequence of GS100R9
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 93 - protein, 108 aa, Artificial Sequence
  amino acid sequence of GS100R35
GPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEA

SEQ ID NO: 94 - DNA, 324 bp, Artificial Sequence
  nucleotide sequence of GS100R35
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 95 - protein, 108 aa, Artificial Sequence
  amino acid sequence of GS100R52
GPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEA

SEQ ID NO: 96 - DNA, 324 bp, Artificial Sequence
  nucleotide sequence of GS100R52
ggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 97 - protein, 108 aa, Artificial Sequence
  amino acid sequence of GS100R74
GPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEP

SEQ ID NO: 98 - DNA, 324 bp, Artificial Sequence
  nucleotide sequence of GS100R74
ggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaacca

SEQ ID NO: 99 - protein, 108 aa, Artificial Sequence
  amino acid sequence of GS100R77
GPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 100 - DNA, 324 bp, Artificial Sequence
  nucleotide sequence of GS100R77
ggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagct

SEQ ID NO: 101 - protein, 108 aa, Artificial Sequence
  amino acid sequence of GS100R98
GPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPA

SEQ ID NO: 102 - DNA, 324 bp, Artificial Sequence
  nucleotide sequence of GS100R98
ggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagct

SEQ ID NO: 103 - protein, 108 aa, Artificial Sequence
  amino acid sequence of GS100R112
GPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEA

SEQ ID NO: 104 - DNA, 324 bp, Artificial Sequence
  nucleotide sequence of GS100R112
ggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagct

SEQ ID NO: 105 - protein, 108 aa, Artificial Sequence
  amino acid sequence of GS100R127
GPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEA

SEQ ID NO: 106 - DNA, 324 bp, Artificial Sequence
  nucleotide sequence of GS100R127
ggtccaccaggtccagctggtgctgaaggtgaagctggtccagctggtgctccaggtgaaccaggtccagaaggtccaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 107 - protein, 108 aa, Artificial Sequence
  amino acid sequence of GS100L23
GAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPA

SEQ ID NO: 108 - DNA, 324 bp, Artificial Sequence
  nucleotide sequence of GS100L23
ggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagct

SEQ ID NO: 109 - protein, 108 aa, Artificial Sequence
  amino acid sequence of GS100L63
GAAGPAGAPGPAGEPGEAGAEGAPGPAGAEGAAGEAGAPGAEGEAGAEGAPGPEGAPGAAGPAGAAGAEGAPGPAGPEGEAGEPGEAGPEGAPGPAGEPGAPGEAGEP

SEQ ID NO: 110 - DNA, 324 bp, Artificial Sequence
  nucleotide sequence of GS100L63
ggtgctgctggtccagctggtgctccaggtccagctggtgaaccaggtgaagctggtgctgaaggtgctccaggtccagctggtgctgaaggtgctgctggtgaagctggtgctccaggtgctgaaggtgaagctggtgctgaaggtgctccaggtccagaaggtgctccaggtgctgctggtccagctggtgctgctggtgctgaaggtgctccaggtccagctggtccagaaggtgaagctggtgaaccaggtgaagctggtccagaaggtgctccaggtccagctggtgaaccaggtgctccaggtgaagctggtgaacca

SEQ ID NO: 111 - protein, 108 aa, Artificial Sequence
  amino acid sequence of GS100L91
GAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEP

SEQ ID NO: 112 - DNA, 324 bp, Artificial Sequence
  nucleotide sequence of GS100L91
ggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaacca

SEQ ID NO: 113 - protein, 108 aa, Artificial Sequence
  amino acid sequence of GS100L102
GEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPA

SEQ ID NO: 114 - DNA, 324 bp, Artificial Sequence
  nucleotide sequence of GS100L102
ggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagct

SEQ ID NO: 115 - protein, 108 aa, Artificial Sequence
  amino acid sequence of GS100L136
GEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPA

SEQ ID NO: 116 - DNA, 324 bp, Artificial Sequence
  nucleotide sequence of GS100L136
ggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagct

SEQ ID NO: 117 - protein, 108 aa, Artificial Sequence
  amino acid sequence of GS100L192
GAEGPAGPEGAAGAPGAAGPPGAEGAPGPAGEAGPEGAPGAAGPAGAPGAEGAAGAPGAEGAAGEPGPAGPAGAAGPPGPAGEPGAPGAEGEPGAAGAPGAEGPPGAA

SEQ ID NO: 118 - DNA, 324 bp, Artificial Sequence
  nucleotide sequence of GS100L192
ggtgctgaaggtccagctggtccagaaggtgctgctggtgctccaggtgctgctggtccaccaggtgctgaaggtgctccaggtccagctggtgaagctggtccagaaggtgctccaggtgctgctggtccagctggtgctccaggtgctgaaggtgctgctggtgctccaggtgctgaaggtgctgctggtgaaccaggtccagctggtccagctggtgctgctggtccaccaggtccagctggtgaaccaggtgctccaggtgctgaaggtgaaccaggtgctgctggtgctccaggtgctgaaggtccaccaggtgctgct

SEQ ID NO: 119 - protein, 108 aa, Artificial Sequence
  amino acid sequence of GS100L146
GAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPE

SEQ ID NO: 120 - DNA, 324 bp, Artificial Sequence
  nucleotide sequence of GS100L146
ggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaa

SEQ ID NO: 121 - protein, 108 aa, Artificial Sequence
  amino acid sequence of GS100L179
GAPGAPGAAGPEGPEGEPGAAGAEGAEGAEGAAGAPGPEGAEGAPGAPGAPGAAGAPGAAGEAGAPGPEGEAGEAGEEGAPGAAGEPGEEGEPGAAGAPGAAGAEGPA

SEQ ID NO: 122 - DNA, 324 bp, Artificial Sequence
  nucleotide sequence of GS100L179
ggtgctccaggtgctccaggtgctgctggtccagaaggtccagaaggtgaaccaggtgctgctggtgctgaaggtgctgaaggtgctgaaggtgctgctggtgctccaggtccagaaggtgctgaaggtgctccaggtgctccaggtgctccaggtgctgctggtgctccaggtgctgctggtgaagctggtgctccaggtccagaaggtgaagctggtgaagctggtgaagaaggtgctccaggtgctgctggtgaaccaggtgaagaaggtgaaccaggtgctgctggtgctccaggtgctgctggtgctgaaggtccagct

SEQ ID NO: 123 - protein, 117 aa, Artificial Sequence
  amino acid sequence of GS100S14
GPPGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPA

SEQ ID NO: 124 - DNA, 351 bp, Artificial Sequence
  nucleotide sequence of GS100S14
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagct

SEQ ID NO: 125 - protein, 108 aa, Artificial Sequence
  amino acid sequence of GS100S45
GPPGAAGAEGPAGAPGAAGAAGEAGPEGAPGEPGAAGEPGAAGPPGAAGAEGPAGAAGPAGAAGAPGAAGEAGAPGEAGAPGAEGPAGPEGAPGAEGAAGAPGAEGAA

SEQ ID NO: 126 - DNA, 324 bp, Artificial Sequence
  nucleotide sequence of GS100S45
ggtccaccaggtgctgctggtgctgaaggtccagctggtgctccaggtgctgctggtgctgctggtgaagctggtccagaaggtgctccaggtgaaccaggtgctgctggtgaaccaggtgctgctggtccaccaggtgctgctggtgctgaaggtccagctggtgctgctggtccagctggtgctgctggtgctccaggtgctgctggtgaagctggtgctccaggtgaagctggtgctccaggtgctgaaggtccagctggtccagaaggtgctccaggtgctgaaggtgctgctggtgctccaggtgctgaaggtgctgct

SEQ ID NO: 127 - protein, 108 aa, Artificial Sequence
  amino acid sequence of GS100S84
GEPGPEGAAGEAGPEGAEGPAGPAGAPGAPGEAGAAGAPGAEGEAGAAGAEGPAGEAGAPGPPGAPGAAGAPGAPGAAGPAGEPGPEGPPGEAGAPGPPGAAGAEGAP

SEQ ID NO: 128 - DNA, 324 bp, Artificial Sequence
  nucleotide sequence of GS100S84
ggtgaaccaggtccagaaggtgctgctggtgaagctggtccagaaggtgctgaaggtccagctggtccagctggtgctccaggtgctccaggtgaagctggtgctgctggtgctccaggtgctgaaggtgaagctggtgctgctggtgctgaaggtccagctggtgaagctggtgctccaggtccaccaggtgctccaggtgctgctggtgctccaggtgctccaggtgctgctggtccagctggtgaaccaggtccagaaggtccaccaggtgaagctggtgctccaggtccaccaggtgctgctggtgctgaaggtgctcca

SEQ ID NO: 129 - protein, 108 aa, Artificial Sequence
  amino acid sequence of GS100S105
GPEGAPGPPGPAGEPGPAGAPGPPGEAGAPGEPGAAGEPGAAGPPGAEGAEGPAGPAGEPGPAGAPGPPGEAGPAGAPGEAGEPGPEGAAGAAGPEGAEGPAGPAGAP

SEQ ID NO: 130 - DNA, 324 bp, Artificial Sequence
  nucleotide sequence of GS100S105
ggtccagaaggtgctccaggtccaccaggtccagctggtgaaccaggtccagctggtgctccaggtccaccaggtgaagctggtgctccaggtgaaccaggtgctgctggtgaaccaggtgctgctggtccaccaggtgctgaaggtgctgaaggtccagctggtccagctggtgaaccaggtccagctggtgctccaggtccaccaggtgaagctggtccagctggtgctccaggtgaagctggtgaaccaggtccagaaggtgctgctggtgctgctggtccagaaggtgctgaaggtccagctggtccagctggtgctcca

SEQ ID NO: 131 - protein, 108 aa, Artificial Sequence
  amino acid sequence of GS100S148
GAAGAPGAAGAAGAPGPAGAAGAPGEAGPAGAPGAAGAPGAEGAAGAPGAEGAPGEAGAAGEAGAPGPAGAPGPEGAPGAPGAPGAPGPAGAPGAPGAPGPAGAEGAP

SEQ ID NO: 132 - DNA, 324 bp, Artificial Sequence
  nucleotide sequence of GS100S148
ggtgctgctggtgctccaggtgctgctggtgctgctggtgctccaggtccagctggtgctgctggtgctccaggtgaagctggtccagctggtgctccaggtgctgctggtgctccaggtgctgaaggtgctgctggtgctccaggtgctgaaggtgctccaggtgaagctggtgctgctggtgaagctggtgctccaggtccagctggtgctccaggtccagaaggtgctccaggtgctccaggtgctccaggtgctccaggtccagctggtgctccaggtgctccaggtgctccaggtccagctggtgctgaaggtgctcca

SEQ ID NO: 133 - protein, 108 aa, Artificial Sequence
  amino acid sequence of GS100S179
GEAGPPGPAGAEGEAGPAGAPGEPGPEGPPGPAGAEGEAGPAGAPGEPGPEGPPGEPGPEGPPGEAGAPGPPGAPGAEGEPGPAGAPGEAGPPGPAGAEGEAGPAGAP

SEQ ID NO: 134 - DNA, 324 bp, Artificial Sequence
  nucleotide sequence of GS100S179
ggtgaagctggtccaccaggtccagctggtgctgaaggtgaagctggtccagctggtgctccaggtgaaccaggtccagaaggtccaccaggtccagctggtgctgaaggtgaagctggtccagctggtgctccaggtgaaccaggtccagaaggtccaccaggtgaaccaggtccagaaggtccaccaggtgaagctggtgctccaggtccaccaggtgctccaggtgctgaaggtgaaccaggtccagctggtgctccaggtgaagctggtccaccaggtccagctggtgctgaaggtgaagctggtccagctggtgctcca

SEQ ID NO: 135 - protein, 117 aa, Artificial Sequence
  amino acid sequence of GS100S203
GPPGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPA

SEQ ID NO: 136 - DNA, 351 bp, Artificial Sequence
  nucleotide sequence of GS100S203
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagct

SEQ ID NO: 137 - protein, 108 aa, Artificial Sequence
  amino acid sequence of GS100S257
GPAGEPGPAGAPGPPGEAGPAGAPGEAGEEGEPGAEGPAGPAGEAGAEGAPGPPGPAGAPGEAGPPGPAGAEGEAGPAGAPGAPGAEGEEGPPGEAGEPGAPGPEGAA

SEQ ID NO: 138 - DNA, 324 bp, Artificial Sequence
  nucleotide sequence of GS100S257
ggtccagctggtgaaccaggtccagctggtgctccaggtccaccaggtgaagctggtccagctggtgctccaggtgaagctggtgaagaaggtgaaccaggtgctgaaggtccagctggtccagctggtgaagctggtgctgaaggtgctccaggtccaccaggtccagctggtgctccaggtgaagctggtccaccaggtccagctggtgctgaaggtgaagctggtccagctggtgctccaggtgctccaggtgctgaaggtgaagaaggtccaccaggtgaagctggtgaaccaggtgctccaggtccagaaggtgctgct

SEQ ID NO: 139 - protein, 459 aa, Artificial Sequence
  amino acid sequence of GS400R9
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 140 - DNA, 1377 bp, Artificial Sequence
  nucleotide sequence of GS400R9
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 141 - protein, 432 aa, Artificial Sequence
  amino acid sequence of GS400R35
GPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEA

SEQ ID NO: 142 - DNA, 1296 bp, Artificial Sequence
  nucleotide sequence of GS400R35
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 143 - protein, 432 aa, Artificial Sequence
  amino acid sequence of GS400R52
GPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEAGPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEAGPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEAGPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEA

SEQ ID NO: 144 - DNA, 1296 bp, Artificial Sequence
  nucleotide sequence of GS400R52
ggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 145 - protein, 432 aa, Artificial Sequence
  amino acid sequence of GS400R74
GPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEPGPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEPGPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEPGPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEP

SEQ ID NO: 146 - DNA, 1296 bp, Artificial Sequence
  nucleotide sequence of GS400R74
ggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaacca

SEQ ID NO: 147 - protein, 432 aa, Artificial Sequence
  amino acid sequence of GS400R77
GPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 148 - DNA, 1296 bp, Artificial Sequence
  nucleotide sequence of GS400R77
ggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagct

SEQ ID NO: 149 - protein, 432 aa, Artificial Sequence
  amino acid sequence of GS400R98
GPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPA

SEQ ID NO: 150 - DNA, 1296 bp, Artificial Sequence
  nucleotide sequence of GS400R98
ggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagct

SEQ ID NO: 151 - protein, 432 aa, Artificial Sequence
  amino acid sequence of GS400R112
GPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEA

SEQ ID NO: 152 - DNA, 1296 bp, Artificial Sequence
  nucleotide sequence of GS400R112
ggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagct

SEQ ID NO: 153 - protein, 432 aa, Artificial Sequence
  amino acid sequence of GS400R127
GPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEA

SEQ ID NO: 154 - DNA, 1296 bp, Artificial Sequence
  nucleotide sequence of GS400R127
ggtccaccaggtccagctggtgctgaaggtgaagctggtccagctggtgctccaggtgaaccaggtccagaaggtccaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtccagctggtgctgaaggtgaagctggtccagctggtgctccaggtgaaccaggtccagaaggtccaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtccagctggtgctgaaggtgaagctggtccagctggtgctccaggtgaaccaggtccagaaggtccaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtccagctggtgctgaaggtgaagctggtccagctggtgctccaggtgaaccaggtccagaaggtccaccaggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 155 - protein, 432 aa, Artificial Sequence
  amino acid sequence of GS400L23
GAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPA

SEQ ID NO: 156 - DNA, 1296 bp, Artificial Sequence
  nucleotide sequence of GS400L23
ggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagct

SEQ ID NO: 157 - protein, 432 aa, Artificial Sequence
  amino acid sequence of GS400L63
GAAGPAGAPGPAGEPGEAGAEGAPGPAGAEGAAGEAGAPGAEGEAGAEGAPGPEGAPGAAGPAGAAGAEGAPGPAGPEGEAGEPGEAGPEGAPGPAGEPGAPGEAGEPGAAGPAGAPGPAGEPGEAGAEGAPGPAGAEGAAGEAGAPGAEGEAGAEGAPGPEGAPGAAGPAGAAGAEGAPGPAGPEGEAGEPGEAGPEGAPGPAGEPGAPGEAGEPGAAGPAGAPGPAGEPGEAGAEGAPGPAGAEGAAGEAGAPGAEGEAGAEGAPGPEGAPGAAGPAGAAGAEGAPGPAGPEGEAGEPGEAGPEGAPGPAGEPGAPGEAGEPGAAGPAGAPGPAGEPGEAGAEGAPGPAGAEGAAGEAGAPGAEGEAGAEGAPGPEGAPGAAGPAGAAGAEGAPGPAGPEGEAGEPGEAGPEGAPGPAGEPGAPGEAGEP

SEQ ID NO: 158 - DNA, 1296 bp, Artificial Sequence
  nucleotide sequence of GS400L63
ggtgctgctggtccagctggtgctccaggtccagctggtgaaccaggtgaagctggtgctgaaggtgctccaggtccagctggtgctgaaggtgctgctggtgaagctggtgctccaggtgctgaaggtgaagctggtgctgaaggtgctccaggtccagaaggtgctccaggtgctgctggtccagctggtgctgctggtgctgaaggtgctccaggtccagctggtccagaaggtgaagctggtgaaccaggtgaagctggtccagaaggtgctccaggtccagctggtgaaccaggtgctccaggtgaagctggtgaaccaggtgctgctggtccagctggtgctccaggtccagctggtgaaccaggtgaagctggtgctgaaggtgctccaggtccagctggtgctgaaggtgctgctggtgaagctggtgctccaggtgctgaaggtgaagctggtgctgaaggtgctccaggtccagaaggtgctccaggtgctgctggtccagctggtgctgctggtgctgaaggtgctccaggtccagctggtccagaaggtgaagctggtgaaccaggtgaagctggtccagaaggtgctccaggtccagctggtgaaccaggtgctccaggtgaagctggtgaaccaggtgctgctggtccagctggtgctccaggtccagctggtgaaccaggtgaagctggtgctgaaggtgctccaggtccagctggtgctgaaggtgctgctggtgaagctggtgctccaggtgctgaaggtgaagctggtgctgaaggtgctccaggtccagaaggtgctccaggtgctgctggtccagctggtgctgctggtgctgaaggtgctccaggtccagctggtccagaaggtgaagctggtgaaccaggtgaagctggtccagaaggtgctccaggtccagctggtgaaccaggtgctccaggtgaagctggtgaaccaggtgctgctggtccagctggtgctccaggtccagctggtgaaccaggtgaagctggtgctgaaggtgctccaggtccagctggtgctgaaggtgctgctggtgaagctggtgctccaggtgctgaaggtgaagctggtgctgaaggtgctccaggtccagaaggtgctccaggtgctgctggtccagctggtgctgctggtgctgaaggtgctccaggtccagctggtccagaaggtgaagctggtgaaccaggtgaagctggtccagaaggtgctccaggtccagctggtgaaccaggtgctccaggtgaagctggtgaacca

SEQ ID NO: 159 - protein, 432 aa, Artificial Sequence
  amino acid sequence of GS400L91
GAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEP

SEQ ID NO: 160 - DNA, 1296 bp, Artificial Sequence
  nucleotide sequence of GS400L91
ggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaacca

SEQ ID NO: 161 - protein, 432 aa, Artificial Sequence
  amino acid sequence of GS400L102
GEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPA

SEQ ID NO: 162 - DNA, 1296 bp, Artificial Sequence
  nucleotide sequence of GS400L102
ggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagct

SEQ ID NO: 163 - protein, 432 aa, Artificial Sequence
  amino acid sequence of GS400L136
GEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPA

SEQ ID NO: 164 - DNA, 1296 bp, Artificial Sequence
  nucleotide sequence of GS400L136
ggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagct

SEQ ID NO: 165 - protein, 432 aa, Artificial Sequence
  amino acid sequence of GS400L192
GAEGPAGPEGAAGAPGAAGPPGAEGAPGPAGEAGPEGAPGAAGPAGAPGAEGAAGAPGAEGAAGEPGPAGPAGAAGPPGPAGEPGAPGAEGEPGAAGAPGAEGPPGAAGAEGPAGPEGAAGAPGAAGPPGAEGAPGPAGEAGPEGAPGAAGPAGAPGAEGAAGAPGAEGAAGEPGPAGPAGAAGPPGPAGEPGAPGAEGEPGAAGAPGAEGPPGAAGAEGPAGPEGAAGAPGAAGPPGAEGAPGPAGEAGPEGAPGAAGPAGAPGAEGAAGAPGAEGAAGEPGPAGPAGAAGPPGPAGEPGAPGAEGEPGAAGAPGAEGPPGAAGAEGPAGPEGAAGAPGAAGPPGAEGAPGPAGEAGPEGAPGAAGPAGAPGAEGAAGAPGAEGAAGEPGPAGPAGAAGPPGPAGEPGAPGAEGEPGAAGAPGAEGPPGAA

SEQ ID NO: 166 - DNA, 1296 bp, Artificial Sequence
  nucleotide sequence of GS400L192
ggtgctgaaggtccagctggtccagaaggtgctgctggtgctccaggtgctgctggtccaccaggtgctgaaggtgctccaggtccagctggtgaagctggtccagaaggtgctccaggtgctgctggtccagctggtgctccaggtgctgaaggtgctgctggtgctccaggtgctgaaggtgctgctggtgaaccaggtccagctggtccagctggtgctgctggtccaccaggtccagctggtgaaccaggtgctccaggtgctgaaggtgaaccaggtgctgctggtgctccaggtgctgaaggtccaccaggtgctgctggtgctgaaggtccagctggtccagaaggtgctgctggtgctccaggtgctgctggtccaccaggtgctgaaggtgctccaggtccagctggtgaagctggtccagaaggtgctccaggtgctgctggtccagctggtgctccaggtgctgaaggtgctgctggtgctccaggtgctgaaggtgctgctggtgaaccaggtccagctggtccagctggtgctgctggtccaccaggtccagctggtgaaccaggtgctccaggtgctgaaggtgaaccaggtgctgctggtgctccaggtgctgaaggtccaccaggtgctgctggtgctgaaggtccagctggtccagaaggtgctgctggtgctccaggtgctgctggtccaccaggtgctgaaggtgctccaggtccagctggtgaagctggtccagaaggtgctccaggtgctgctggtccagctggtgctccaggtgctgaaggtgctgctggtgctccaggtgctgaaggtgctgctggtgaaccaggtccagctggtccagctggtgctgctggtccaccaggtccagctggtgaaccaggtgctccaggtgctgaaggtgaaccaggtgctgctggtgctccaggtgctgaaggtccaccaggtgctgctggtgctgaaggtccagctggtccagaaggtgctgctggtgctccaggtgctgctggtccaccaggtgctgaaggtgctccaggtccagctggtgaagctggtccagaaggtgctccaggtgctgctggtccagctggtgctccaggtgctgaaggtgctgctggtgctccaggtgctgaaggtgctgctggtgaaccaggtccagctggtccagctggtgctgctggtccaccaggtccagctggtgaaccaggtgctccaggtgctgaaggtgaaccaggtgctgctggtgctccaggtgctgaaggtccaccaggtgctgct

SEQ ID NO: 167 - protein, 432 aa, Artificial Sequence
  amino acid sequence of GS400L146
GAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPE

SEQ ID NO: 168 - DNA, 1296 bp, Artificial Sequence
  nucleotide sequence of GS400L146
ggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaa

SEQ ID NO: 169 - protein, 432 aa, Artificial Sequence
  amino acid sequence of GS400L179
GAPGAPGAAGPEGPEGEPGAAGAEGAEGAEGAAGAPGPEGAEGAPGAPGAPGAAGAPGAAGEAGAPGPEGEAGEAGEEGAPGAAGEPGEEGEPGAAGAPGAAGAEGPAGAPGAPGAAGPEGPEGEPGAAGAEGAEGAEGAAGAPGPEGAEGAPGAPGAPGAAGAPGAAGEAGAPGPEGEAGEAGEEGAPGAAGEPGEEGEPGAAGAPGAAGAEGPAGAPGAPGAAGPEGPEGEPGAAGAEGAEGAEGAAGAPGPEGAEGAPGAPGAPGAAGAPGAAGEAGAPGPEGEAGEAGEEGAPGAAGEPGEEGEPGAAGAPGAAGAEGPAGAPGAPGAAGPEGPEGEPGAAGAEGAEGAEGAAGAPGPEGAEGAPGAPGAPGAAGAPGAAGEAGAPGPEGEAGEAGEEGAPGAAGEPGEEGEPGAAGAPGAAGAEGPA

SEQ ID NO: 170 - DNA, 1296 bp, Artificial Sequence
  nucleotide sequence of GS400L179
ggtgctccaggtgctccaggtgctgctggtccagaaggtccagaaggtgaaccaggtgctgctggtgctgaaggtgctgaaggtgctgaaggtgctgctggtgctccaggtccagaaggtgctgaaggtgctccaggtgctccaggtgctccaggtgctgctggtgctccaggtgctgctggtgaagctggtgctccaggtccagaaggtgaagctggtgaagctggtgaagaaggtgctccaggtgctgctggtgaaccaggtgaagaaggtgaaccaggtgctgctggtgctccaggtgctgctggtgctgaaggtccagctggtgctccaggtgctccaggtgctgctggtccagaaggtccagaaggtgaaccaggtgctgctggtgctgaaggtgctgaaggtgctgaaggtgctgctggtgctccaggtccagaaggtgctgaaggtgctccaggtgctccaggtgctccaggtgctgctggtgctccaggtgctgctggtgaagctggtgctccaggtccagaaggtgaagctggtgaagctggtgaagaaggtgctccaggtgctgctggtgaaccaggtgaagaaggtgaaccaggtgctgctggtgctccaggtgctgctggtgctgaaggtccagctggtgctccaggtgctccaggtgctgctggtccagaaggtccagaaggtgaaccaggtgctgctggtgctgaaggtgctgaaggtgctgaaggtgctgctggtgctccaggtccagaaggtgctgaaggtgctccaggtgctccaggtgctccaggtgctgctggtgctccaggtgctgctggtgaagctggtgctccaggtccagaaggtgaagctggtgaagctggtgaagaaggtgctccaggtgctgctggtgaaccaggtgaagaaggtgaaccaggtgctgctggtgctccaggtgctgctggtgctgaaggtccagctggtgctccaggtgctccaggtgctgctggtccagaaggtccagaaggtgaaccaggtgctgctggtgctgaaggtgctgaaggtgctgaaggtgctgctggtgctccaggtccagaaggtgctgaaggtgctccaggtgctccaggtgctccaggtgctgctggtgctccaggtgctgctggtgaagctggtgctccaggtccagaaggtgaagctggtgaagctggtgaagaaggtgctccaggtgctgctggtgaaccaggtgaagaaggtgaaccaggtgctgctggtgctccaggtgctgctggtgctgaaggtccagct

SEQ ID NO: 171 - protein, 459 aa, Artificial Sequence
  amino acid sequence of GS400S14
GPPGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPA

SEQ ID NO: 172 - DNA, 1377 bp, Artificial Sequence
  nucleotide sequence of GS400S14
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagct

SEQ ID NO: 173 - protein, 432 aa, Artificial Sequence
  amino acid sequence of GS400S45
GPPGAAGAEGPAGAPGAAGAAGEAGPEGAPGEPGAAGEPGAAGPPGAAGAEGPAGAAGPAGAAGAPGAAGEAGAPGEAGAPGAEGPAGPEGAPGAEGAAGAPGAEGAAGPPGAAGAEGPAGAPGAAGAAGEAGPEGAPGEPGAAGEPGAAGPPGAAGAEGPAGAAGPAGAAGAPGAAGEAGAPGEAGAPGAEGPAGPEGAPGAEGAAGAPGAEGAAGPPGAAGAEGPAGAPGAAGAAGEAGPEGAPGEPGAAGEPGAAGPPGAAGAEGPAGAAGPAGAAGAPGAAGEAGAPGEAGAPGAEGPAGPEGAPGAEGAAGAPGAEGAAGPPGAAGAEGPAGAPGAAGAAGEAGPEGAPGEPGAAGEPGAAGPPGAAGAEGPAGAAGPAGAAGAPGAAGEAGAPGEAGAPGAEGPAGPEGAPGAEGAAGAPGAEGAA

SEQ ID NO: 174 - DNA, 1296 bp, Artificial Sequence
  nucleotide sequence of GS400S45
ggtccaccaggtgctgctggtgctgaaggtccagctggtgctccaggtgctgctggtgctgctggtgaagctggtccagaaggtgctccaggtgaaccaggtgctgctggtgaaccaggtgctgctggtccaccaggtgctgctggtgctgaaggtccagctggtgctgctggtccagctggtgctgctggtgctccaggtgctgctggtgaagctggtgctccaggtgaagctggtgctccaggtgctgaaggtccagctggtccagaaggtgctccaggtgctgaaggtgctgctggtgctccaggtgctgaaggtgctgctggtccaccaggtgctgctggtgctgaaggtccagctggtgctccaggtgctgctggtgctgctggtgaagctggtccagaaggtgctccaggtgaaccaggtgctgctggtgaaccaggtgctgctggtccaccaggtgctgctggtgctgaaggtccagctggtgctgctggtccagctggtgctgctggtgctccaggtgctgctggtgaagctggtgctccaggtgaagctggtgctccaggtgctgaaggtccagctggtccagaaggtgctccaggtgctgaaggtgctgctggtgctccaggtgctgaaggtgctgctggtccaccaggtgctgctggtgctgaaggtccagctggtgctccaggtgctgctggtgctgctggtgaagctggtccagaaggtgctccaggtgaaccaggtgctgctggtgaaccaggtgctgctggtccaccaggtgctgctggtgctgaaggtccagctggtgctgctggtccagctggtgctgctggtgctccaggtgctgctggtgaagctggtgctccaggtgaagctggtgctccaggtgctgaaggtccagctggtccagaaggtgctccaggtgctgaaggtgctgctggtgctccaggtgctgaaggtgctgctggtccaccaggtgctgctggtgctgaaggtccagctggtgctccaggtgctgctggtgctgctggtgaagctggtccagaaggtgctccaggtgaaccaggtgctgctggtgaaccaggtgctgctggtccaccaggtgctgctggtgctgaaggtccagctggtgctgctggtccagctggtgctgctggtgctccaggtgctgctggtgaagctggtgctccaggtgaagctggtgctccaggtgctgaaggtccagctggtccagaaggtgctccaggtgctgaaggtgctgctggtgctccaggtgctgaaggtgctgct

SEQ ID NO: 175 - protein, 432 aa, Artificial Sequence
  amino acid sequence of GS400S84
GEPGPEGAAGEAGPEGAEGPAGPAGAPGAPGEAGAAGAPGAEGEAGAAGAEGPAGEAGAPGPPGAPGAAGAPGAPGAAGPAGEPGPEGPPGEAGAPGPPGAAGAEGAPGEPGPEGAAGEAGPEGAEGPAGPAGAPGAPGEAGAAGAPGAEGEAGAAGAEGPAGEAGAPGPPGAPGAAGAPGAPGAAGPAGEPGPEGPPGEAGAPGPPGAAGAEGAPGEPGPEGAAGEAGPEGAEGPAGPAGAPGAPGEAGAAGAPGAEGEAGAAGAEGPAGEAGAPGPPGAPGAAGAPGAPGAAGPAGEPGPEGPPGEAGAPGPPGAAGAEGAPGEPGPEGAAGEAGPEGAEGPAGPAGAPGAPGEAGAAGAPGAEGEAGAAGAEGPAGEAGAPGPPGAPGAAGAPGAPGAAGPAGEPGPEGPPGEAGAPGPPGAAGAEGAP

SEQ ID NO: 176 - DNA, 1296 bp, Artificial Sequence
  nucleotide sequence of GS400S84
ggtgaaccaggtccagaaggtgctgctggtgaagctggtccagaaggtgctgaaggtccagctggtccagctggtgctccaggtgctccaggtgaagctggtgctgctggtgctccaggtgctgaaggtgaagctggtgctgctggtgctgaaggtccagctggtgaagctggtgctccaggtccaccaggtgctccaggtgctgctggtgctccaggtgctccaggtgctgctggtccagctggtgaaccaggtccagaaggtccaccaggtgaagctggtgctccaggtccaccaggtgctgctggtgctgaaggtgctccaggtgaaccaggtccagaaggtgctgctggtgaagctggtccagaaggtgctgaaggtccagctggtccagctggtgctccaggtgctccaggtgaagctggtgctgctggtgctccaggtgctgaaggtgaagctggtgctgctggtgctgaaggtccagctggtgaagctggtgctccaggtccaccaggtgctccaggtgctgctggtgctccaggtgctccaggtgctgctggtccagctggtgaaccaggtccagaaggtccaccaggtgaagctggtgctccaggtccaccaggtgctgctggtgctgaaggtgctccaggtgaaccaggtccagaaggtgctgctggtgaagctggtccagaaggtgctgaaggtccagctggtccagctggtgctccaggtgctccaggtgaagctggtgctgctggtgctccaggtgctgaaggtgaagctggtgctgctggtgctgaaggtccagctggtgaagctggtgctccaggtccaccaggtgctccaggtgctgctggtgctccaggtgctccaggtgctgctggtccagctggtgaaccaggtccagaaggtccaccaggtgaagctggtgctccaggtccaccaggtgctgctggtgctgaaggtgctccaggtgaaccaggtccagaaggtgctgctggtgaagctggtccagaaggtgctgaaggtccagctggtccagctggtgctccaggtgctccaggtgaagctggtgctgctggtgctccaggtgctgaaggtgaagctggtgctgctggtgctgaaggtccagctggtgaagctggtgctccaggtccaccaggtgctccaggtgctgctggtgctccaggtgctccaggtgctgctggtccagctggtgaaccaggtccagaaggtccaccaggtgaagctggtgctccaggtccaccaggtgctgctggtgctgaaggtgctcca

SEQ ID NO: 177 - protein, 432 aa, Artificial Sequence
  amino acid sequence of GS400S105
GPEGAPGPPGPAGEPGPAGAPGPPGEAGAPGEPGAAGEPGAAGPPGAEGAEGPAGPAGEPGPAGAPGPPGEAGPAGAPGEAGEPGPEGAAGAAGPEGAEGPAGPAGAPGPEGAPGPPGPAGEPGPAGAPGPPGEAGAPGEPGAAGEPGAAGPPGAEGAEGPAGPAGEPGPAGAPGPPGEAGPAGAPGEAGEPGPEGAAGAAGPEGAEGPAGPAGAPGPEGAPGPPGPAGEPGPAGAPGPPGEAGAPGEPGAAGEPGAAGPPGAEGAEGPAGPAGEPGPAGAPGPPGEAGPAGAPGEAGEPGPEGAAGAAGPEGAEGPAGPAGAPGPEGAPGPPGPAGEPGPAGAPGPPGEAGAPGEPGAAGEPGAAGPPGAEGAEGPAGPAGEPGPAGAPGPPGEAGPAGAPGEAGEPGPEGAAGAAGPEGAEGPAGPAGAP

SEQ ID NO: 178 - DNA, 1296 bp, Artificial Sequence
  nucleotide sequence of GS400S105
ggtccagaaggtgctccaggtccaccaggtccagctggtgaaccaggtccagctggtgctccaggtccaccaggtgaagctggtgctccaggtgaaccaggtgctgctggtgaaccaggtgctgctggtccaccaggtgctgaaggtgctgaaggtccagctggtccagctggtgaaccaggtccagctggtgctccaggtccaccaggtgaagctggtccagctggtgctccaggtgaagctggtgaaccaggtccagaaggtgctgctggtgctgctggtccagaaggtgctgaaggtccagctggtccagctggtgctccaggtccagaaggtgctccaggtccaccaggtccagctggtgaaccaggtccagctggtgctccaggtccaccaggtgaagctggtgctccaggtgaaccaggtgctgctggtgaaccaggtgctgctggtccaccaggtgctgaaggtgctgaaggtccagctggtccagctggtgaaccaggtccagctggtgctccaggtccaccaggtgaagctggtccagctggtgctccaggtgaagctggtgaaccaggtccagaaggtgctgctggtgctgctggtccagaaggtgctgaaggtccagctggtccagctggtgctccaggtccagaaggtgctccaggtccaccaggtccagctggtgaaccaggtccagctggtgctccaggtccaccaggtgaagctggtgctccaggtgaaccaggtgctgctggtgaaccaggtgctgctggtccaccaggtgctgaaggtgctgaaggtccagctggtccagctggtgaaccaggtccagctggtgctccaggtccaccaggtgaagctggtccagctggtgctccaggtgaagctggtgaaccaggtccagaaggtgctgctggtgctgctggtccagaaggtgctgaaggtccagctggtccagctggtgctccaggtccagaaggtgctccaggtccaccaggtccagctggtgaaccaggtccagctggtgctccaggtccaccaggtgaagctggtgctccaggtgaaccaggtgctgctggtgaaccaggtgctgctggtccaccaggtgctgaaggtgctgaaggtccagctggtccagctggtgaaccaggtccagctggtgctccaggtccaccaggtgaagctggtccagctggtgctccaggtgaagctggtgaaccaggtccagaaggtgctgctggtgctgctggtccagaaggtgctgaaggtccagctggtccagctggtgctcca

SEQ ID NO: 179 - protein, 432 aa, Artificial Sequence
  amino acid sequence of GS400S148
GAAGAPGAAGAAGAPGPAGAAGAPGEAGPAGAPGAAGAPGAEGAAGAPGAEGAPGEAGAAGEAGAPGPAGAPGPEGAPGAPGAPGAPGPAGAPGAPGAPGPAGAEGAPGAAGAPGAAGAAGAPGPAGAAGAPGEAGPAGAPGAAGAPGAEGAAGAPGAEGAPGEAGAAGEAGAPGPAGAPGPEGAPGAPGAPGAPGPAGAPGAPGAPGPAGAEGAPGAAGAPGAAGAAGAPGPAGAAGAPGEAGPAGAPGAAGAPGAEGAAGAPGAEGAPGEAGAAGEAGAPGPAGAPGPEGAPGAPGAPGAPGPAGAPGAPGAPGPAGAEGAPGAAGAPGAAGAAGAPGPAGAAGAPGEAGPAGAPGAAGAPGAEGAAGAPGAEGAPGEAGAAGEAGAPGPAGAPGPEGAPGAPGAPGAPGPAGAPGAPGAPGPAGAEGAP

SEQ ID NO: 180 - DNA, 1296 bp, Artificial Sequence
  nucleotide sequence of GS400S148
ggtgctgctggtgctccaggtgctgctggtgctgctggtgctccaggtccagctggtgctgctggtgctccaggtgaagctggtccagctggtgctccaggtgctgctggtgctccaggtgctgaaggtgctgctggtgctccaggtgctgaaggtgctccaggtgaagctggtgctgctggtgaagctggtgctccaggtccagctggtgctccaggtccagaaggtgctccaggtgctccaggtgctccaggtgctccaggtccagctggtgctccaggtgctccaggtgctccaggtccagctggtgctgaaggtgctccaggtgctgctggtgctccaggtgctgctggtgctgctggtgctccaggtccagctggtgctgctggtgctccaggtgaagctggtccagctggtgctccaggtgctgctggtgctccaggtgctgaaggtgctgctggtgctccaggtgctgaaggtgctccaggtgaagctggtgctgctggtgaagctggtgctccaggtccagctggtgctccaggtccagaaggtgctccaggtgctccaggtgctccaggtgctccaggtccagctggtgctccaggtgctccaggtgctccaggtccagctggtgctgaaggtgctccaggtgctgctggtgctccaggtgctgctggtgctgctggtgctccaggtccagctggtgctgctggtgctccaggtgaagctggtccagctggtgctccaggtgctgctggtgctccaggtgctgaaggtgctgctggtgctccaggtgctgaaggtgctccaggtgaagctggtgctgctggtgaagctggtgctccaggtccagctggtgctccaggtccagaaggtgctccaggtgctccaggtgctccaggtgctccaggtccagctggtgctccaggtgctccaggtgctccaggtccagctggtgctgaaggtgctccaggtgctgctggtgctccaggtgctgctggtgctgctggtgctccaggtccagctggtgctgctggtgctccaggtgaagctggtccagctggtgctccaggtgctgctggtgctccaggtgctgaaggtgctgctggtgctccaggtgctgaaggtgctccaggtgaagctggtgctgctggtgaagctggtgctccaggtccagctggtgctccaggtccagaaggtgctccaggtgctccaggtgctccaggtgctccaggtccagctggtgctccaggtgctccaggtgctccaggtccagctggtgctgaaggtgctcca

SEQ ID NO: 181 - protein, 432 aa, Artificial Sequence
  amino acid sequence of GS400S179
GEAGPPGPAGAEGEAGPAGAPGEPGPEGPPGPAGAEGEAGPAGAPGEPGPEGPPGEPGPEGPPGEAGAPGPPGAPGAEGEPGPAGAPGEAGPPGPAGAEGEAGPAGAPGEAGPPGPAGAEGEAGPAGAPGEPGPEGPPGPAGAEGEAGPAGAPGEPGPEGPPGEPGPEGPPGEAGAPGPPGAPGAEGEPGPAGAPGEAGPPGPAGAEGEAGPAGAPGEAGPPGPAGAEGEAGPAGAPGEPGPEGPPGPAGAEGEAGPAGAPGEPGPEGPPGEPGPEGPPGEAGAPGPPGAPGAEGEPGPAGAPGEAGPPGPAGAEGEAGPAGAPGEAGPPGPAGAEGEAGPAGAPGEPGPEGPPGPAGAEGEAGPAGAPGEPGPEGPPGEPGPEGPPGEAGAPGPPGAPGAEGEPGPAGAPGEAGPPGPAGAEGEAGPAGAP

SEQ ID NO: 182 - DNA, 1296 bp, Artificial Sequence
  nucleotide sequence of GS400S179
ggtgaagctggtccaccaggtccagctggtgctgaaggtgaagctggtccagctggtgctccaggtgaaccaggtccagaaggtccaccaggtccagctggtgctgaaggtgaagctggtccagctggtgctccaggtgaaccaggtccagaaggtccaccaggtgaaccaggtccagaaggtccaccaggtgaagctggtgctccaggtccaccaggtgctccaggtgctgaaggtgaaccaggtccagctggtgctccaggtgaagctggtccaccaggtccagctggtgctgaaggtgaagctggtccagctggtgctccaggtgaagctggtccaccaggtccagctggtgctgaaggtgaagctggtccagctggtgctccaggtgaaccaggtccagaaggtccaccaggtccagctggtgctgaaggtgaagctggtccagctggtgctccaggtgaaccaggtccagaaggtccaccaggtgaaccaggtccagaaggtccaccaggtgaagctggtgctccaggtccaccaggtgctccaggtgctgaaggtgaaccaggtccagctggtgctccaggtgaagctggtccaccaggtccagctggtgctgaaggtgaagctggtccagctggtgctccaggtgaagctggtccaccaggtccagctggtgctgaaggtgaagctggtccagctggtgctccaggtgaaccaggtccagaaggtccaccaggtccagctggtgctgaaggtgaagctggtccagctggtgctccaggtgaaccaggtccagaaggtccaccaggtgaaccaggtccagaaggtccaccaggtgaagctggtgctccaggtccaccaggtgctccaggtgctgaaggtgaaccaggtccagctggtgctccaggtgaagctggtccaccaggtccagctggtgctgaaggtgaagctggtccagctggtgctccaggtgaagctggtccaccaggtccagctggtgctgaaggtgaagctggtccagctggtgctccaggtgaaccaggtccagaaggtccaccaggtccagctggtgctgaaggtgaagctggtccagctggtgctccaggtgaaccaggtccagaaggtccaccaggtgaaccaggtccagaaggtccaccaggtgaagctggtgctccaggtccaccaggtgctccaggtgctgaaggtgaaccaggtccagctggtgctccaggtgaagctggtccaccaggtccagctggtgctgaaggtgaagctggtccagctggtgctcca

SEQ ID NO: 183 - protein, 459 aa, Artificial Sequence
  amino acid sequence of GS400S203
GPPGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPA

SEQ ID NO: 184 - DNA, 1377 bp, Artificial Sequence
  nucleotide sequence of GS400S203
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagct

SEQ ID NO: 185 - protein, 432 aa, Artificial Sequence
  amino acid sequence of GS400S257
GPAGEPGPAGAPGPPGEAGPAGAPGEAGEEGEPGAEGPAGPAGEAGAEGAPGPPGPAGAPGEAGPPGPAGAEGEAGPAGAPGAPGAEGEEGPPGEAGEPGAPGPEGAAGPAGEPGPAGAPGPPGEAGPAGAPGEAGEEGEPGAEGPAGPAGEAGAEGAPGPPGPAGAPGEAGPPGPAGAEGEAGPAGAPGAPGAEGEEGPPGEAGEPGAPGPEGAAGPAGEPGPAGAPGPPGEAGPAGAPGEAGEEGEPGAEGPAGPAGEAGAEGAPGPPGPAGAPGEAGPPGPAGAEGEAGPAGAPGAPGAEGEEGPPGEAGEPGAPGPEGAAGPAGEPGPAGAPGPPGEAGPAGAPGEAGEEGEPGAEGPAGPAGEAGAEGAPGPPGPAGAPGEAGPPGPAGAEGEAGPAGAPGAPGAEGEEGPPGEAGEPGAPGPEGAA

SEQ ID NO: 186 - DNA, 1296 bp, Artificial Sequence
  nucleotide sequence of GS400S257
ggtccagctggtgaaccaggtccagctggtgctccaggtccaccaggtgaagctggtccagctggtgctccaggtgaagctggtgaagaaggtgaaccaggtgctgaaggtccagctggtccagctggtgaagctggtgctgaaggtgctccaggtccaccaggtccagctggtgctccaggtgaagctggtccaccaggtccagctggtgctgaaggtgaagctggtccagctggtgctccaggtgctccaggtgctgaaggtgaagaaggtccaccaggtgaagctggtgaaccaggtgctccaggtccagaaggtgctgctggtccagctggtgaaccaggtccagctggtgctccaggtccaccaggtgaagctggtccagctggtgctccaggtgaagctggtgaagaaggtgaaccaggtgctgaaggtccagctggtccagctggtgaagctggtgctgaaggtgctccaggtccaccaggtccagctggtgctccaggtgaagctggtccaccaggtccagctggtgctgaaggtgaagctggtccagctggtgctccaggtgctccaggtgctgaaggtgaagaaggtccaccaggtgaagctggtgaaccaggtgctccaggtccagaaggtgctgctggtccagctggtgaaccaggtccagctggtgctccaggtccaccaggtgaagctggtccagctggtgctccaggtgaagctggtgaagaaggtgaaccaggtgctgaaggtccagctggtccagctggtgaagctggtgctgaaggtgctccaggtccaccaggtccagctggtgctccaggtgaagctggtccaccaggtccagctggtgctgaaggtgaagctggtccagctggtgctccaggtgctccaggtgctgaaggtgaagaaggtccaccaggtgaagctggtgaaccaggtgctccaggtccagaaggtgctgctggtccagctggtgaaccaggtccagctggtgctccaggtccaccaggtgaagctggtccagctggtgctccaggtgaagctggtgaagaaggtgaaccaggtgctgaaggtccagctggtccagctggtgaagctggtgctgaaggtgctccaggtccaccaggtccagctggtgctccaggtgaagctggtccaccaggtccagctggtgctgaaggtgaagctggtccagctggtgctccaggtgctccaggtgctgaaggtgaagaaggtccaccaggtgaagctggtgaaccaggtgctccaggtccagaaggtgctgct

SEQ ID NO: 187 - protein, 432 aa, Artificial Sequence
  amino acid sequence of GLK1 (4 amino acids, GAPY)
GYAGPPGPAGAYGYAGPAGAPGYPGPYGPPGPAGAYGYAGPAGAPGYPGPYGPPGYPGPYGPPGYAGAPGPPGAPGAYGYPGPAGAPGYAGPPGPAGAYGYAGPAGAPGYAGPPGPAGAYGYAGPAGAPGYPGPYGPPGPAGAYGYAGPAGAPGYPGPYGPPGYPGPYGPPGYAGAPGPPGAPGAYGYPGPAGAPGYAGPPGPAGAYGYAGPAGAPGYAGPPGPAGAYGYAGPAGAPGYPGPYGPPGPAGAYGYAGPAGAPGYPGPYGPPGYPGPYGPPGYAGAPGPPGAPGAYGYPGPAGAPGYAGPPGPAGAYGYAGPAGAPGYAGPPGPAGAYGYAGPAGAPGYPGPYGPPGPAGAYGYAGPAGAPGYPGPYGPPGYPGPYGPPGYAGAPGPPGAPGAYGYPGPAGAPGYAGPPGPAGAYGYAGPAGAP

SEQ ID NO: 188 - DNA, 1296 bp, Artificial Sequence
  nucleotide sequence of GLK1 (4 amino acids, GAPY)
ggttacgctggtccaccaggtccagctggtgcttacggttacgctggtccagctggtgctccaggttacccaggtccatacggtccaccaggtccagctggtgcttacggttacgctggtccagctggtgctccaggttacccaggtccatacggtccaccaggttacccaggtccatacggtccaccaggttacgctggtgctccaggtccaccaggtgctccaggtgcttacggttacccaggtccagctggtgctccaggttacgctggtccaccaggtccagctggtgcttacggttacgctggtccagctggtgctccaggttacgctggtccaccaggtccagctggtgcttacggttacgctggtccagctggtgctccaggttacccaggtccatacggtccaccaggtccagctggtgcttacggttacgctggtccagctggtgctccaggttacccaggtccatacggtccaccaggttacccaggtccatacggtccaccaggttacgctggtgctccaggtccaccaggtgctccaggtgcttacggttacccaggtccagctggtgctccaggttacgctggtccaccaggtccagctggtgcttacggttacgctggtccagctggtgctccaggttacgctggtccaccaggtccagctggtgcttacggttacgctggtccagctggtgctccaggttacccaggtccatacggtccaccaggtccagctggtgcttacggttacgctggtccagctggtgctccaggttacccaggtccatacggtccaccaggttacccaggtccatacggtccaccaggttacgctggtgctccaggtccaccaggtgctccaggtgcttacggttacccaggtccagctggtgctccaggttacgctggtccaccaggtccagctggtgcttacggttacgctggtccagctggtgctccaggttacgctggtccaccaggtccagctggtgcttacggttacgctggtccagctggtgctccaggttacccaggtccatacggtccaccaggtccagctggtgcttacggttacgctggtccagctggtgctccaggttacccaggtccatacggtccaccaggttacccaggtccatacggtccaccaggttacgctggtgctccaggtccaccaggtgctccaggtgcttacggttacccaggtccagctggtgctccaggttacgctggtccaccaggtccagctggtgcttacggttacgctggtccagctggtgctcca

SEQ ID NO: 189 - protein, 432 aa, Artificial Sequence
  amino acid sequence of GLK2 (4 amino acids, GLPY)
GYLGPPGPLGLYGYLGPLGLPGYPGPYGPPGPLGLYGYLGPLGLPGYPGPYGPPGYPGPYGPPGYLGLPGPPGLPGLYGYPGPLGLPGYLGPPGPLGLYGYLGPLGLPGYLGPPGPLGLYGYLGPLGLPGYPGPYGPPGPLGLYGYLGPLGLPGYPGPYGPPGYPGPYGPPGYLGLPGPPGLPGLYGYPGPLGLPGYLGPPGPLGLYGYLGPLGLPGYLGPPGPLGLYGYLGPLGLPGYPGPYGPPGPLGLYGYLGPLGLPGYPGPYGPPGYPGPYGPPGYLGLPGPPGLPGLYGYPGPLGLPGYLGPPGPLGLYGYLGPLGLPGYLGPPGPLGLYGYLGPLGLPGYPGPYGPPGPLGLYGYLGPLGLPGYPGPYGPPGYPGPYGPPGYLGLPGPPGLPGLYGYPGPLGLPGYLGPPGPLGLYGYLGPLGLP

SEQ ID NO: 190 - DNA, 1296 bp, Artificial Sequence
  nucleotide sequence of GLK2 (4 amino acids, GLPY)
ggttacttgggtccaccaggtccattgggtttgtacggttacttgggtccattgggtttgccaggttacccaggtccatacggtccaccaggtccattgggtttgtacggttacttgggtccattgggtttgccaggttacccaggtccatacggtccaccaggttacccaggtccatacggtccaccaggttacttgggtttgccaggtccaccaggtttgccaggtttgtacggttacccaggtccattgggtttgccaggttacttgggtccaccaggtccattgggtttgtacggttacttgggtccattgggtttgccaggttacttgggtccaccaggtccattgggtttgtacggttacttgggtccattgggtttgccaggttacccaggtccatacggtccaccaggtccattgggtttgtacggttacttgggtccattgggtttgccaggttacccaggtccatacggtccaccaggttacccaggtccatacggtccaccaggttacttgggtttgccaggtccaccaggtttgccaggtttgtacggttacccaggtccattgggtttgccaggttacttgggtccaccaggtccattgggtttgtacggttacttgggtccattgggtttgccaggttacttgggtccaccaggtccattgggtttgtacggttacttgggtccattgggtttgccaggttacccaggtccatacggtccaccaggtccattgggtttgtacggttacttgggtccattgggtttgccaggttacccaggtccatacggtccaccaggttacccaggtccatacggtccaccaggttacttgggtttgccaggtccaccaggtttgccaggtttgtacggttacccaggtccattgggtttgccaggttacttgggtccaccaggtccattgggtttgtacggttacttgggtccattgggtttgccaggttacttgggtccaccaggtccattgggtttgtacggttacttgggtccattgggtttgccaggttacccaggtccatacggtccaccaggtccattgggtttgtacggttacttgggtccattgggtttgccaggttacccaggtccatacggtccaccaggttacccaggtccatacggtccaccaggttacttgggtttgccaggtccaccaggtttgccaggtttgtacggttacccaggtccattgggtttgccaggttacttgggtccaccaggtccattgggtttgtacggttacttgggtccattgggtttgcca

SEQ ID NO: 191 - protein, 432 aa, Artificial Sequence
  amino acid sequence of GLK3(4 amino acids, GAPD)
GDAGPPGPAGADGDAGPAGAPGDPGPDGPPGPAGADGDAGPAGAPGDPGPDGPPGDPGPDGPPGDAGAPGPPGAPGADGDPGPAGAPGDAGPPGPAGADGDAGPAGAPGDAGPPGPAGADGDAGPAGAPGDPGPDGPPGPAGADGDAGPAGAPGDPGPDGPPGDPGPDGPPGDAGAPGPPGAPGADGDPGPAGAPGDAGPPGPAGADGDAGPAGAPGDAGPPGPAGADGDAGPAGAPGDPGPDGPPGPAGADGDAGPAGAPGDPGPDGPPGDPGPDGPPGDAGAPGPPGAPGADGDPGPAGAPGDAGPPGPAGADGDAGPAGAPGDAGPPGPAGADGDAGPAGAPGDPGPDGPPGPAGADGDAGPAGAPGDPGPDGPPGDPGPDGPPGDAGAPGPPGAPGADGDPGPAGAPGDAGPPGPAGADGDAGPAGAP

SEQ ID NO: 192 - DNA, 1296 bp, Artificial Sequence
  nucleotide sequence of GLK3(4 amino acids, GAPD)
ggtgatgctggtccaccaggtccagctggtgctgatggtgatgctggtccagctggtgctccaggtgatccaggtccagatggtccaccaggtccagctggtgctgatggtgatgctggtccagctggtgctccaggtgatccaggtccagatggtccaccaggtgatccaggtccagatggtccaccaggtgatgctggtgctccaggtccaccaggtgctccaggtgctgatggtgatccaggtccagctggtgctccaggtgatgctggtccaccaggtccagctggtgctgatggtgatgctggtccagctggtgctccaggtgatgctggtccaccaggtccagctggtgctgatggtgatgctggtccagctggtgctccaggtgatccaggtccagatggtccaccaggtccagctggtgctgatggtgatgctggtccagctggtgctccaggtgatccaggtccagatggtccaccaggtgatccaggtccagatggtccaccaggtgatgctggtgctccaggtccaccaggtgctccaggtgctgatggtgatccaggtccagctggtgctccaggtgatgctggtccaccaggtccagctggtgctgatggtgatgctggtccagctggtgctccaggtgatgctggtccaccaggtccagctggtgctgatggtgatgctggtccagctggtgctccaggtgatccaggtccagatggtccaccaggtccagctggtgctgatggtgatgctggtccagctggtgctccaggtgatccaggtccagatggtccaccaggtgatccaggtccagatggtccaccaggtgatgctggtgctccaggtccaccaggtgctccaggtgctgatggtgatccaggtccagctggtgctccaggtgatgctggtccaccaggtccagctggtgctgatggtgatgctggtccagctggtgctccaggtgatgctggtccaccaggtccagctggtgctgatggtgatgctggtccagctggtgctccaggtgatccaggtccagatggtccaccaggtccagctggtgctgatggtgatgctggtccagctggtgctccaggtgatccaggtccagatggtccaccaggtgatccaggtccagatggtccaccaggtgatgctggtgctccaggtccaccaggtgctccaggtgctgatggtgatccaggtccagctggtgctccaggtgatgctggtccaccaggtccagctggtgctgatggtgatgctggtccagctggtgctcca

SEQ ID NO: 193 - protein, 432 aa, Artificial Sequence
  amino acid sequence of GLK4(6 amino acids, GAPEYH)
GEAGPHGPAGAEGEAGHAGAPGEYGPEGPYGPAGAEGEAGPAGAYGEPGPEGPHGEPGPEGPYGEAGAPGPHGAPGAEGEPGPAGAHGEAGPPGYAGAEGEAGYAGAPGEAGPHGPAGAEGEAGHAGAPGEYGPEGPYGPAGAEGEAGPAGAYGEPGPEGPHGEPGPEGPYGEAGAPGPHGAPGAEGEPGPAGAHGEAGPPGYAGAEGEAGYAGAPGEAGPHGPAGAEGEAGHAGAPGEYGPEGPYGPAGAEGEAGPAGAYGEPGPEGPHGEPGPEGPYGEAGAPGPHGAPGAEGEPGPAGAHGEAGPPGYAGAEGEAGYAGAPGEAGPHGPAGAEGEAGHAGAPGEYGPEGPYGPAGAEGEAGPAGAYGEPGPEGPHGEPGPEGPYGEAGAPGPHGAPGAEGEPGPAGAHGEAGPPGYAGAEGEAGYAGAP

SEQ ID NO: 194 - DNA, 1296 bp, Artificial Sequence
  nucleotide sequence of GLK4(6 amino acids, GAPEYH)
ggtgaagctggtccacatggtccagctggtgctgaaggtgaagctggtcatgctggtgctccaggtgaatacggtccagaaggtccatacggtccagctggtgctgaaggtgaagctggtccagctggtgcttacggtgaaccaggtccagaaggtccacatggtgaaccaggtccagaaggtccatacggtgaagctggtgctccaggtccacatggtgctccaggtgctgaaggtgaaccaggtccagctggtgctcatggtgaagctggtccaccaggttacgctggtgctgaaggtgaagctggttacgctggtgctccaggtgaagctggtccacatggtccagctggtgctgaaggtgaagctggtcatgctggtgctccaggtgaatacggtccagaaggtccatacggtccagctggtgctgaaggtgaagctggtccagctggtgcttacggtgaaccaggtccagaaggtccacatggtgaaccaggtccagaaggtccatacggtgaagctggtgctccaggtccacatggtgctccaggtgctgaaggtgaaccaggtccagctggtgctcatggtgaagctggtccaccaggttacgctggtgctgaaggtgaagctggttacgctggtgctccaggtgaagctggtccacatggtccagctggtgctgaaggtgaagctggtcatgctggtgctccaggtgaatacggtccagaaggtccatacggtccagctggtgctgaaggtgaagctggtccagctggtgcttacggtgaaccaggtccagaaggtccacatggtgaaccaggtccagaaggtccatacggtgaagctggtgctccaggtccacatggtgctccaggtgctgaaggtgaaccaggtccagctggtgctcatggtgaagctggtccaccaggttacgctggtgctgaaggtgaagctggttacgctggtgctccaggtgaagctggtccacatggtccagctggtgctgaaggtgaagctggtcatgctggtgctccaggtgaatacggtccagaaggtccatacggtccagctggtgctgaaggtgaagctggtccagctggtgcttacggtgaaccaggtccagaaggtccacatggtgaaccaggtccagaaggtccatacggtgaagctggtgctccaggtccacatggtgctccaggtgctgaaggtgaaccaggtccagctggtgctcatggtgaagctggtccaccaggttacgctggtgctgaaggtgaagctggttacgctggtgctcca

SEQ ID NO: 195 - protein, 432 aa, Artificial Sequence
  amino acid sequence of GLK5(6 amino acids, GAPEWD)
GDAGPWGPAGAEGEAGPAGAPGEWGPEGPDGPAGADGEAGPAGAPGEPGPWGPPGEWGPEGPDGEAGAWGPPGAPGADGEPGPWGAPGEAGPPGPDGAEGEAGPWGAPGDAGPWGPAGAEGEAGPAGAPGEWGPEGPDGPAGADGEAGPAGAPGEPGPWGPPGEWGPEGPDGEAGAWGPPGAPGADGEPGPWGAPGEAGPPGPDGAEGEAGPWGAPGDAGPWGPAGAEGEAGPAGAPGEWGPEGPDGPAGADGEAGPAGAPGEPGPWGPPGEWGPEGPDGEAGAWGPPGAPGADGEPGPWGAPGEAGPPGPDGAEGEAGPWGAPGDAGPWGPAGAEGEAGPAGAPGEWGPEGPDGPAGADGEAGPAGAPGEPGPWGPPGEWGPEGPDGEAGAWGPPGAPGADGEPGPWGAPGEAGPPGPDGAEGEAGPWGAP

SEQ ID NO: 196 - DNA, 1296 bp, Artificial Sequence
  nucleotide sequence of GLK5(6 amino acids, GAPEWD)
ggtgatgctggtccatggggtccagctggtgctgaaggtgaagctggtccagctggtgctccaggtgaatggggtccagaaggtccagatggtccagctggtgctgatggtgaagctggtccagctggtgctccaggtgaaccaggtccatggggtccaccaggtgaatggggtccagaaggtccagatggtgaagctggtgcttggggtccaccaggtgctccaggtgctgatggtgaaccaggtccatggggtgctccaggtgaagctggtccaccaggtccagatggtgctgaaggtgaagctggtccatggggtgctccaggtgatgctggtccatggggtccagctggtgctgaaggtgaagctggtccagctggtgctccaggtgaatggggtccagaaggtccagatggtccagctggtgctgatggtgaagctggtccagctggtgctccaggtgaaccaggtccatggggtccaccaggtgaatggggtccagaaggtccagatggtgaagctggtgcttggggtccaccaggtgctccaggtgctgatggtgaaccaggtccatggggtgctccaggtgaagctggtccaccaggtccagatggtgctgaaggtgaagctggtccatggggtgctccaggtgatgctggtccatggggtccagctggtgctgaaggtgaagctggtccagctggtgctccaggtgaatggggtccagaaggtccagatggtccagctggtgctgatggtgaagctggtccagctggtgctccaggtgaaccaggtccatggggtccaccaggtgaatggggtccagaaggtccagatggtgaagctggtgcttggggtccaccaggtgctccaggtgctgatggtgaaccaggtccatggggtgctccaggtgaagctggtccaccaggtccagatggtgctgaaggtgaagctggtccatggggtgctccaggtgatgctggtccatggggtccagctggtgctgaaggtgaagctggtccagctggtgctccaggtgaatggggtccagaaggtccagatggtccagctggtgctgatggtgaagctggtccagctggtgctccaggtgaaccaggtccatggggtccaccaggtgaatggggtccagaaggtccagatggtgaagctggtgcttggggtccaccaggtgctccaggtgctgatggtgaaccaggtccatggggtgctccaggtgaagctggtccaccaggtccagatggtgctgaaggtgaagctggtccatggggtgctcca

SEQ ID NO: 197 - protein, 432 aa, Artificial Sequence
  amino acid sequence of GLK6(8 amino acids, GAPEWDYH)
GEAGPWGPAGAEGEAGDAGAPGEPGPEGPYGPAGAEGEAGHAGAPGEDGPEGPWGEPGPEGPWGEAGDPGPYGAPGAEGEHGPAGAPGEAGPHGPAGADGEAGWAGAPGEAGPWGPAGAEGEAGDAGAPGEPGPEGPYGPAGAEGEAGHAGAPGEDGPEGPWGEPGPEGPWGEAGDPGPYGAPGAEGEHGPAGAPGEAGPHGPAGADGEAGWAGAPGEAGPWGPAGAEGEAGDAGAPGEPGPEGPYGPAGAEGEAGHAGAPGEDGPEGPWGEPGPEGPWGEAGDPGPYGAPGAEGEHGPAGAPGEAGPHGPAGADGEAGWAGAPGEAGPWGPAGAEGEAGDAGAPGEPGPEGPYGPAGAEGEAGHAGAPGEDGPEGPWGEPGPEGPWGEAGDPGPYGAPGAEGEHGPAGAPGEAGPHGPAGADGEAGWAGAP

SEQ ID NO: 198 - DNA, 1296 bp, Artificial Sequence
  nucleotide sequence of GLK6(8 amino acids, GAPEWDYH)
ggtgaagctggtccatggggtccagctggtgctgaaggtgaagctggtgatgctggtgctccaggtgaaccaggtccagaaggtccatacggtccagctggtgctgaaggtgaagctggtcatgctggtgctccaggtgaagatggtccagaaggtccatggggtgaaccaggtccagaaggtccatggggtgaagctggtgatccaggtccatacggtgctccaggtgctgaaggtgaacatggtccagctggtgctccaggtgaagctggtccacatggtccagctggtgctgatggtgaagctggttgggctggtgctccaggtgaagctggtccatggggtccagctggtgctgaaggtgaagctggtgatgctggtgctccaggtgaaccaggtccagaaggtccatacggtccagctggtgctgaaggtgaagctggtcatgctggtgctccaggtgaagatggtccagaaggtccatggggtgaaccaggtccagaaggtccatggggtgaagctggtgatccaggtccatacggtgctccaggtgctgaaggtgaacatggtccagctggtgctccaggtgaagctggtccacatggtccagctggtgctgatggtgaagctggttgggctggtgctccaggtgaagctggtccatggggtccagctggtgctgaaggtgaagctggtgatgctggtgctccaggtgaaccaggtccagaaggtccatacggtccagctggtgctgaaggtgaagctggtcatgctggtgctccaggtgaagatggtccagaaggtccatggggtgaaccaggtccagaaggtccatggggtgaagctggtgatccaggtccatacggtgctccaggtgctgaaggtgaacatggtccagctggtgctccaggtgaagctggtccacatggtccagctggtgctgatggtgaagctggttgggctggtgctccaggtgaagctggtccatggggtccagctggtgctgaaggtgaagctggtgatgctggtgctccaggtgaaccaggtccagaaggtccatacggtccagctggtgctgaaggtgaagctggtcatgctggtgctccaggtgaagatggtccagaaggtccatggggtgaaccaggtccagaaggtccatggggtgaagctggtgatccaggtccatacggtgctccaggtgctgaaggtgaacatggtccagctggtgctccaggtgaagctggtccacatggtccagctggtgctgatggtgaagctggttgggctggtgctcca

SEQ ID NO: 199 - protein, 432 aa, Artificial Sequence
  amino acid sequence of GLK7(8 amino acids,GAPESKQH)
GEAGPSGPAGAEGEKGPAGAPGEQGPEGPHGPAGAEGEHGPAGAQGEPGPEGPSGEPGPEGPKGESGAPGPQGAPGAEGEHGPQGAPGEAGPKGPAGAHGEAGPAGAPGEAGPSGPAGAEGEKGPAGAPGEQGPEGPHGPAGAEGEHGPAGAQGEPGPEGPSGEPGPEGPKGESGAPGPQGAPGAEGEHGPQGAPGEAGPKGPAGAHGEAGPAGAPGEAGPSGPAGAEGEKGPAGAPGEQGPEGPHGPAGAEGEHGPAGAQGEPGPEGPSGEPGPEGPKGESGAPGPQGAPGAEGEHGPQGAPGEAGPKGPAGAHGEAGPAGAPGEAGPSGPAGAEGEKGPAGAPGEQGPEGPHGPAGAEGEHGPAGAQGEPGPEGPSGEPGPEGPKGESGAPGPQGAPGAEGEHGPQGAPGEAGPKGPAGAHGEAGPAGAP

SEQ ID NO: 200 - DNA, 1296 bp, Artificial Sequence
  nucleotide sequence of GLK7(8 amino acids,GAPESKQH)
ggtgaagctggtccatctggtccagctggtgctgaaggtgaaaagggtccagctggtgctccaggtgaacaaggtccagaaggtccacatggtccagctggtgctgaaggtgaacatggtccagctggtgctcaaggtgaaccaggtccagaaggtccatctggtgaaccaggtccagaaggtccaaagggtgaatctggtgctccaggtccacaaggtgctccaggtgctgaaggtgaacatggtccacaaggtgctccaggtgaagctggtccaaagggtccagctggtgctcatggtgaagctggtccagctggtgctccaggtgaagctggtccatctggtccagctggtgctgaaggtgaaaagggtccagctggtgctccaggtgaacaaggtccagaaggtccacatggtccagctggtgctgaaggtgaacatggtccagctggtgctcaaggtgaaccaggtccagaaggtccatctggtgaaccaggtccagaaggtccaaagggtgaatctggtgctccaggtccacaaggtgctccaggtgctgaaggtgaacatggtccacaaggtgctccaggtgaagctggtccaaagggtccagctggtgctcatggtgaagctggtccagctggtgctccaggtgaagctggtccatctggtccagctggtgctgaaggtgaaaagggtccagctggtgctccaggtgaacaaggtccagaaggtccacatggtccagctggtgctgaaggtgaacatggtccagctggtgctcaaggtgaaccaggtccagaaggtccatctggtgaaccaggtccagaaggtccaaagggtgaatctggtgctccaggtccacaaggtgctccaggtgctgaaggtgaacatggtccacaaggtgctccaggtgaagctggtccaaagggtccagctggtgctcatggtgaagctggtccagctggtgctccaggtgaagctggtccatctggtccagctggtgctgaaggtgaaaagggtccagctggtgctccaggtgaacaaggtccagaaggtccacatggtccagctggtgctgaaggtgaacatggtccagctggtgctcaaggtgaaccaggtccagaaggtccatctggtgaaccaggtccagaaggtccaaagggtgaatctggtgctccaggtccacaaggtgctccaggtgctgaaggtgaacatggtccacaaggtgctccaggtgaagctggtccaaagggtccagctggtgctcatggtgaagctggtccagctggtgctcca

SEQ ID NO: 201 - protein, 432 aa, Artificial Sequence
  amino acid sequence of GLK8(10 amino acids, GLSQNWKRDP)
GDNGPLGPNGNSGDLGPNGNQGDPGPDGPNGPNGNDGDNGPWGNPGDPGPDGPKGDPGPDGPRGDNGNPGPSGNPGNDGDPGPNGNPGDNGPNGPNGNDGDSGPPGNPGDNGPLGPNGNSGDLGPNGNQGDPGPDGPNGPNGNDGDNGPWGNPGDPGPDGPKGDPGPDGPRGDNGNPGPSGNPGNDGDPGPNGNPGDNGPNGPNGNDGDSGPPGNPGDNGPLGPNGNSGDLGPNGNQGDPGPDGPNGPNGNDGDNGPWGNPGDPGPDGPKGDPGPDGPRGDNGNPGPSGNPGNDGDPGPNGNPGDNGPNGPNGNDGDSGPPGNPGDNGPLGPNGNSGDLGPNGNQGDPGPDGPNGPNGNDGDNGPWGNPGDPGPDGPKGDPGPDGPRGDNGNPGPSGNPGNDGDPGPNGNPGDNGPNGPNGNDGDSGPPGNP

SEQ ID NO: 202 - DNA, 1296 bp, Artificial Sequence
  nucleotide sequence of GLK8(10 amino acids, GLSQNWKRDP)
ggtgataacggtccattgggtccaaacggtaactctggtgatttgggtccaaacggtaaccaaggtgatccaggtccagatggtccaaacggtccaaacggtaacgatggtgataacggtccatggggtaacccaggtgatccaggtccagatggtccaaagggtgatccaggtccagatggtccaagaggtgataacggtaacccaggtccatctggtaacccaggtaacgatggtgatccaggtccaaacggtaacccaggtgataacggtccaaacggtccaaacggtaacgatggtgattctggtccaccaggtaacccaggtgataacggtccattgggtccaaacggtaactctggtgatttgggtccaaacggtaaccaaggtgatccaggtccagatggtccaaacggtccaaacggtaacgatggtgataacggtccatggggtaacccaggtgatccaggtccagatggtccaaagggtgatccaggtccagatggtccaagaggtgataacggtaacccaggtccatctggtaacccaggtaacgatggtgatccaggtccaaacggtaacccaggtgataacggtccaaacggtccaaacggtaacgatggtgattctggtccaccaggtaacccaggtgataacggtccattgggtccaaacggtaactctggtgatttgggtccaaacggtaaccaaggtgatccaggtccagatggtccaaacggtccaaacggtaacgatggtgataacggtccatggggtaacccaggtgatccaggtccagatggtccaaagggtgatccaggtccagatggtccaagaggtgataacggtaacccaggtccatctggtaacccaggtaacgatggtgatccaggtccaaacggtaacccaggtgataacggtccaaacggtccaaacggtaacgatggtgattctggtccaccaggtaacccaggtgataacggtccattgggtccaaacggtaactctggtgatttgggtccaaacggtaaccaaggtgatccaggtccagatggtccaaacggtccaaacggtaacgatggtgataacggtccatggggtaacccaggtgatccaggtccagatggtccaaagggtgatccaggtccagatggtccaagaggtgataacggtaacccaggtccatctggtaacccaggtaacgatggtgatccaggtccaaacggtaacccaggtgataacggtccaaacggtccaaacggtaacgatggtgattctggtccaccaggtaaccca

SEQ ID NO: 203 - protein, 432 aa, Artificial Sequence
  amino acid sequence of GLK9(10 amino acids,GFPVENWYDQ)
GEFGPYGPVGFEGEFGPFGNPGEYGPEGPWGPFGFEGEWGPFGFPGEPGPEGPWGEPGPEGPQGEFGYPGPPGFPGVEGEPGPDGFPGENGPQGPFGVEGEFGPWGFPGEFGPYGPVGFEGEFGPFGNPGEYGPEGPWGPFGFEGEWGPFGFPGEPGPEGPWGEPGPEGPQGEFGYPGPPGFPGVEGEPGPDGFPGENGPQGPFGVEGEFGPWGFPGEFGPYGPVGFEGEFGPFGNPGEYGPEGPWGPFGFEGEWGPFGFPGEPGPEGPWGEPGPEGPQGEFGYPGPPGFPGVEGEPGPDGFPGENGPQGPFGVEGEFGPWGFPGEFGPYGPVGFEGEFGPFGNPGEYGPEGPWGPFGFEGEWGPFGFPGEPGPEGPWGEPGPEGPQGEFGYPGPPGFPGVEGEPGPDGFPGENGPQGPFGVEGEFGPWGFP

SEQ ID NO: 204 - DNA, 1296 bp, Artificial Sequence
  nucleotide sequence of GLK9(10 amino acids,GFPVENWYDQ)
ggtgaatttggtccatacggtccagttggttttgaaggtgaatttggtccatttggtaacccaggtgaatacggtccagaaggtccatggggtccatttggttttgaaggtgaatggggtccatttggttttccaggtgaaccaggtccagaaggtccatggggtgaaccaggtccagaaggtccacaaggtgaatttggttacccaggtccaccaggttttccaggtgttgaaggtgaaccaggtccagatggttttccaggtgaaaacggtccacaaggtccatttggtgttgaaggtgaatttggtccatggggttttccaggtgaatttggtccatacggtccagttggttttgaaggtgaatttggtccatttggtaacccaggtgaatacggtccagaaggtccatggggtccatttggttttgaaggtgaatggggtccatttggttttccaggtgaaccaggtccagaaggtccatggggtgaaccaggtccagaaggtccacaaggtgaatttggttacccaggtccaccaggttttccaggtgttgaaggtgaaccaggtccagatggttttccaggtgaaaacggtccacaaggtccatttggtgttgaaggtgaatttggtccatggggttttccaggtgaatttggtccatacggtccagttggttttgaaggtgaatttggtccatttggtaacccaggtgaatacggtccagaaggtccatggggtccatttggttttgaaggtgaatggggtccatttggttttccaggtgaaccaggtccagaaggtccatggggtgaaccaggtccagaaggtccacaaggtgaatttggttacccaggtccaccaggttttccaggtgttgaaggtgaaccaggtccagatggttttccaggtgaaaacggtccacaaggtccatttggtgttgaaggtgaatttggtccatggggttttccaggtgaatttggtccatacggtccagttggttttgaaggtgaatttggtccatttggtaacccaggtgaatacggtccagaaggtccatggggtccatttggttttgaaggtgaatggggtccatttggttttccaggtgaaccaggtccagaaggtccatggggtgaaccaggtccagaaggtccacaaggtgaatttggttacccaggtccaccaggttttccaggtgttgaaggtgaaccaggtccagatggttttccaggtgaaaacggtccacaaggtccatttggtgttgaaggtgaatttggtccatggggttttcca

SEQ ID NO: 205 - protein, 432 aa, Artificial Sequence
  amino acid sequence of GLK10(12 amino acids, GFPVENWYDQIK)
GEFGPYGPVGIEGENGPIGQPGEWGPEGPYGPIGIEGDQGPIGKPGEWGPEGPQGEPGPEGPDGEIGVPGPKGDPGIEGDPGPQGIPGEIGPFGPWGFDGEIGPNGIPGEFGPYGPVGIEGENGPIGQPGEWGPEGPYGPIGIEGDQGPIGKPGEWGPEGPQGEPGPEGPDGEIGVPGPKGDPGIEGDPGPQGIPGEIGPFGPWGFDGEIGPNGIPGEFGPYGPVGIEGENGPIGQPGEWGPEGPYGPIGIEGDQGPIGKPGEWGPEGPQGEPGPEGPDGEIGVPGPKGDPGIEGDPGPQGIPGEIGPFGPWGFDGEIGPNGIPGEFGPYGPVGIEGENGPIGQPGEWGPEGPYGPIGIEGDQGPIGKPGEWGPEGPQGEPGPEGPDGEIGVPGPKGDPGIEGDPGPQGIPGEIGPFGPWGFDGEIGPNGIP

SEQ ID NO: 206 - DNA, 1296 bp, Artificial Sequence
  nucleotide sequence of GLK10(12 amino acids, GFPVENWYDQIK)
ggtgaatttggtccatacggtccagttggtattgaaggtgaaaacggtccaattggtcaaccaggtgaatggggtccagaaggtccatacggtccaattggtattgaaggtgatcaaggtccaattggtaagccaggtgaatggggtccagaaggtccacaaggtgaaccaggtccagaaggtccagatggtgaaattggtgttccaggtccaaagggtgatccaggtattgaaggtgatccaggtccacaaggtattccaggtgaaattggtccatttggtccatggggttttgatggtgaaattggtccaaacggtattccaggtgaatttggtccatacggtccagttggtattgaaggtgaaaacggtccaattggtcaaccaggtgaatggggtccagaaggtccatacggtccaattggtattgaaggtgatcaaggtccaattggtaagccaggtgaatggggtccagaaggtccacaaggtgaaccaggtccagaaggtccagatggtgaaattggtgttccaggtccaaagggtgatccaggtattgaaggtgatccaggtccacaaggtattccaggtgaaattggtccatttggtccatggggttttgatggtgaaattggtccaaacggtattccaggtgaatttggtccatacggtccagttggtattgaaggtgaaaacggtccaattggtcaaccaggtgaatggggtccagaaggtccatacggtccaattggtattgaaggtgatcaaggtccaattggtaagccaggtgaatggggtccagaaggtccacaaggtgaaccaggtccagaaggtccagatggtgaaattggtgttccaggtccaaagggtgatccaggtattgaaggtgatccaggtccacaaggtattccaggtgaaattggtccatttggtccatggggttttgatggtgaaattggtccaaacggtattccaggtgaatttggtccatacggtccagttggtattgaaggtgaaaacggtccaattggtcaaccaggtgaatggggtccagaaggtccatacggtccaattggtattgaaggtgatcaaggtccaattggtaagccaggtgaatggggtccagaaggtccacaaggtgaaccaggtccagaaggtccagatggtgaaattggtgttccaggtccaaagggtgatccaggtattgaaggtgatccaggtccacaaggtattccaggtgaaattggtccatttggtccatggggttttgatggtgaaattggtccaaacggtattcca

SEQ ID NO: 207 - protein, 432 aa, Artificial Sequence
  amino acid sequence of GLK11(12 amino acids,  GFSVENWYDQLT)
GEFGPYGPVGSEGENGPTGQPGEWGPEGPYGPSGSEGDQGPTGKPGEWGPEGPQGEPGPEGPDGESGVPGPKGDPGSEGDPGPQGLPGESGPFGPWGFDGESGPNGLPGEFGPYGPVGSEGENGPTGQPGEWGPEGPYGPSGSEGDQGPTGKPGEWGPEGPQGEPGPEGPDGESGVPGPKGDPGSEGDPGPQGLPGESGPFGPWGFDGESGPNGLPGEFGPYGPVGSEGENGPTGQPGEWGPEGPYGPSGSEGDQGPTGKPGEWGPEGPQGEPGPEGPDGESGVPGPKGDPGSEGDPGPQGLPGESGPFGPWGFDGESGPNGLPGEFGPYGPVGSEGENGPTGQPGEWGPEGPYGPSGSEGDQGPTGKPGEWGPEGPQGEPGPEGPDGESGVPGPKGDPGSEGDPGPQGLPGESGPFGPWGFDGESGPNGLP

SEQ ID NO: 208 - DNA, 1296 bp, Artificial Sequence
  nucleotide sequence of GLK11(12 amino acids,  GFSVENWYDQLT)
ggtgaatttggtccatacggtccagttggttctgaaggtgaaaacggtccaactggtcaaccaggtgaatggggtccagaaggtccatacggtccatctggttctgaaggtgatcaaggtccaactggtaagccaggtgaatggggtccagaaggtccacaaggtgaaccaggtccagaaggtccagatggtgaatctggtgttccaggtccaaagggtgatccaggttctgaaggtgatccaggtccacaaggtttgccaggtgaatctggtccatttggtccatggggttttgatggtgaatctggtccaaacggtttgccaggtgaatttggtccatacggtccagttggttctgaaggtgaaaacggtccaactggtcaaccaggtgaatggggtccagaaggtccatacggtccatctggttctgaaggtgatcaaggtccaactggtaagccaggtgaatggggtccagaaggtccacaaggtgaaccaggtccagaaggtccagatggtgaatctggtgttccaggtccaaagggtgatccaggttctgaaggtgatccaggtccacaaggtttgccaggtgaatctggtccatttggtccatggggttttgatggtgaatctggtccaaacggtttgccaggtgaatttggtccatacggtccagttggttctgaaggtgaaaacggtccaactggtcaaccaggtgaatggggtccagaaggtccatacggtccatctggttctgaaggtgatcaaggtccaactggtaagccaggtgaatggggtccagaaggtccacaaggtgaaccaggtccagaaggtccagatggtgaatctggtgttccaggtccaaagggtgatccaggttctgaaggtgatccaggtccacaaggtttgccaggtgaatctggtccatttggtccatggggttttgatggtgaatctggtccaaacggtttgccaggtgaatttggtccatacggtccagttggttctgaaggtgaaaacggtccaactggtcaaccaggtgaatggggtccagaaggtccatacggtccatctggttctgaaggtgatcaaggtccaactggtaagccaggtgaatggggtccagaaggtccacaaggtgaaccaggtccagaaggtccagatggtgaatctggtgttccaggtccaaagggtgatccaggttctgaaggtgatccaggtccacaaggtttgccaggtgaatctggtccatttggtccatggggttttgatggtgaatctggtccaaacggtttgcca

SEQ ID NO: 209 - protein, 438 aa, Artificial Sequence
  amino acid sequence of rGLK1164
GPPGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGGS

SEQ ID NO: 210 - DNA, 1314 bp, Artificial Sequence
  nucleotide sequence of rGLK1164
ggtccacccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtggctct

SEQ ID NO: 211 - protein, 440 aa, Artificial Sequence
  amino acid sequence of GS100R9-hArg1
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 212 - DNA, 1320 bp, Artificial Sequence
  nucleotide sequence of GS100R9-hArg1
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 213 - protein, 430 aa, Artificial Sequence
  amino acid sequence of GS100R35-hArg1
GPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 214 - DNA, 1290 bp, Artificial Sequence
  nucleotide sequence of GS100R35-hArg1
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 215 - protein, 430 aa, Artificial Sequence
  amino acid sequence of GS100R52-hArg1
GPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 216 - DNA, 1290 bp, Artificial Sequence
  nucleotide sequence of GS100R52-hArg1
ggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 217 - protein, 557 aa, Artificial Sequence
  amino acid sequence of GS100R9-hArg1-GS100R9
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 218 - DNA, 1671 bp, Artificial Sequence
  nucleotide sequence of GS100R9-hArg1-GS100R9
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 219 - protein, 538 aa, Artificial Sequence
  amino acid sequence of GS100R35-hArg1-GS100R35
GPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEA

SEQ ID NO: 220 - DNA, 1614 bp, Artificial Sequence
  nucleotide sequence of GS100R35-hArg1-GS100R35
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 221 - protein, 538 aa, Artificial Sequence
  amino acid sequence of GS100R52-hArg1-GS100R52
GPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEA

SEQ ID NO: 222 - DNA, 1614 bp, Artificial Sequence
  nucleotide sequence of GS100R52-hArg1-GS100R52
ggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 223 - protein, 538 aa, Artificial Sequence
  amino acid sequence of GS100R74-hArg1-GS100R74
GPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEPGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEP

SEQ ID NO: 224 - DNA, 1614 bp, Artificial Sequence
  nucleotide sequence of GS100R74-hArg1-GS100R74
ggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaacca

SEQ ID NO: 225 - protein, 538 aa, Artificial Sequence
  amino acid sequence of GS100R77-hArg1-GS100R77
GPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 226 - DNA, 1614 bp, Artificial Sequence
  nucleotide sequence of GS100R77-hArg1-GS100R77
ggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagct

SEQ ID NO: 227 - protein, 538 aa, Artificial Sequence
  amino acid sequence of GS100R98-hArg1-GS100R98
GPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPA

SEQ ID NO: 228 - DNA, 1614 bp, Artificial Sequence
  nucleotide sequence of GS100R98-hArg1-GS100R98
ggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagct

SEQ ID NO: 229 - protein, 538 aa, Artificial Sequence
  amino acid sequence of GS100R112-hArg1-GS100R112
GPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEA

SEQ ID NO: 230 - DNA, 1614 bp, Artificial Sequence
  nucleotide sequence of GS100R112-hArg1-GS100R112
ggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagct

SEQ ID NO: 231 - protein, 554 aa, Artificial Sequence
  amino acid sequence of GS200R9-hArg1
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 232 - DNA, 1662 bp, Artificial Sequence
  nucleotide sequence of GS200R9-hArg1
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 233 - protein, 785 aa, Artificial Sequence
  amino acid sequence of GS200R9-hArg1-GS200R9
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 234 - DNA, 2355 bp, Artificial Sequence
  nucleotide sequence of GS200R9-hArg1-GS200R9
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 235 - protein, 1241 aa, Artificial Sequence
  amino acid sequence of GS400R9-hArg1-GS400R9
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 236 - DNA, 3723 bp, Artificial Sequence
  nucleotide sequence of GS400R9-hArg1-GS400R9
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 237 - protein, 1186 aa, Artificial Sequence
  amino acid sequence of GS400R77-hArg1-GS400R77
GPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPKGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 238 - DNA, 3558 bp, Artificial Sequence
  nucleotide sequence of GS400R77-hArg1-GS400R77
ggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggttctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaagggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagct

SEQ ID NO: 239 - protein, 896 aa, Artificial Sequence
  amino acid sequence of GS500R9-hArg1
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 240 - DNA, 2688 bp, Artificial Sequence
  nucleotide sequence of GS500R9-hArg1
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 241 - protein, 782 aa, Artificial Sequence
  amino acid sequence of GLKRD-hArg1
PEGGPGPPPAGAAAPPPPGPGEGEEAGGPEPPEPPAGGAGAGEGPPGPPEAEPGEPGGPAPGPAPGGGAGEPGGPAGPEGEEAPGGEPAAAPPGPGPPGAPAGPEGEGAPEGEPPGPPAEPGGAAGAGPGPPPGGGPAEAPPGGPGPGGAPPAGGGEAEGPPPEPEAEAAPGGAAGEAPPGPGPAPPGAPAPGPGGGPEPGAAPGGGAAEEEPGAGPGPGEAGAPAPEAAEPGPGPEEEGEPGEAEGGPGPAGPAGAGAPAAPGAPEAGGEEPPPAPPGGPAAEGEAGGPAEGGAPPAPPGAGGAEEGPGAGEPAPGGEEGPPAPAPAAPGPEAEEGPAAPPPAPEPPGAAEGGAAAPGGGGGAGGEGGAEGAAGGGGEPAAGGGGGPGEPGGGGPGGGAGGGEEGEPPAPGPEPPGPPAGAPPGAGEPGEEGPAGGAPPGPEEEPGGAGPEPAGGEGPGPSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 242 - DNA, 2346 bp, Artificial Sequence
  nucleotide sequence of GLKRD-hArg1
ccagaaggtggtccaggtccaccaccagctggtgctgctgctccaccaccaccaggtccaggtgaaggtgaagaagctggtggtccagaaccaccagaaccaccagctggtggtgctggtgctggtgaaggtccaccaggtccaccagaagctgaaccaggtgaaccaggtggtccagctccaggtccagctccaggtggtggtgctggtgaaccaggtggtccagctggtccagaaggtgaagaagctccaggtggtgaaccagctgctgctccaccaggtccaggtccaccaggtgctccagctggtccagaaggtgaaggtgctccagaaggtgaaccaccaggtccaccagctgaaccaggtggtgctgctggtgctggtccaggtccaccaccaggtggtggtccagctgaagctccaccaggtggtccaggtccaggtggtgctccaccagctggtggtggtgaagctgaaggtccaccaccagaaccagaagctgaagctgctccaggtggtgctgctggtgaagctccaccaggtccaggtccagctccaccaggtgctccagctccaggtccaggtggtggtccagaaccaggtgctgctccaggtggtggtgctgctgaagaagaaccaggtgctggtccaggtccaggtgaagctggtgctccagctccagaagctgctgaaccaggtccaggtccagaagaagaaggtgaaccaggtgaagctgaaggtggtccaggtccagctggtccagctggtgctggtgctccagctgctccaggtgctccagaagctggtggtgaagaaccaccaccagctccaccaggtggtccagctgctgaaggtgaagctggtggtccagctgaaggtggtgctccaccagctccaccaggtgctggtggtgctgaagaaggtccaggtgctggtgaaccagctccaggtggtgaagaaggtccaccagctccagctccagctgctccaggtccagaagctgaagaaggtccagctgctccaccaccagctccagaaccaccaggtgctgctgaaggtggtgctgctgctccaggtggtggtggtggtgctggtggtgaaggtggtgctgaaggtgctgctggtggtggtggtgaaccagctgctggtggtggtggtggtccaggtgaaccaggtggtggtggtccaggtggtggtgctggtggtggtgaagaaggtgaaccaccagctccaggtccagaaccaccaggtccaccagctggtgctccaccaggtgctggtgaaccaggtgaagaaggtccagctggtggtgctccaccaggtccagaagaagaaccaggtggtgctggtccagaaccagctggtggtgaaggtccaggtccatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 243 - protein, 761 aa, Artificial Sequence
  amino acid sequence of rGLK1164-hArg1
GPPGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGGSGGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 244 - DNA, 2283 bp, Artificial Sequence
  nucleotide sequence of rGLK1164-hArg1
ggtccacccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtggctctggtggatctgctaagtctagaactattggtattattggtgctccattttctaagggtcaaccaagaggtggtgttgaagaaggtccaactgttttgagaaaggctggtttgttggaaaagttgaaggaacaagaatgtgatgttaaggattacggtgatttgccatttgctgatattccaaacgattctccatttcaaattgttaagaacccaagatctgttggtaaggcttctgaacaattggctggtaaggttgctgaagttaagaagaacggtagaatttctttggttttgggtggtgatcattctttggctattggttctatttctggtcatgctagagttcatccagatttgggtgttatttgggttgatgctcatactgatattaacactccattgactactacttctggtaacttgcatggtcaaccagtttcttttttgttgaaggaattgaagggtaagattccagatgttccaggtttttcttgggttactccatgtatttctgctaaggatattgtttacattggtttgagagatgttgatccaggtgaacattacattttgaagactttgggtattaagtacttttctatgactgaagttgatagattgggtattggtaaggttatggaagaaactttgtcttacttgttgggtagaaagaagagaccaattcatttgtcttttgatgttgatggtttggatccatcttttactccagctactggtactccagttgttggtggtttgacttacagagaaggtttgtacattactgaagaaatttacaagactggtttgttgtctggtttggatattatggaagttaacccatctttgggtaagactccagaagaagttactagaactgttaacactgctgttgctattactttggcttgttttggtttggctagagaaggtaaccataagccaattgattacttgaacccaccaaag

SEQ ID NO: 245 - protein, 472 aa, Artificial Sequence
  amino acid sequence of GEE151-hArg1
GEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGEEGSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 246 - DNA, 1416 bp, Artificial Sequence
  nucleotide sequence of GEE151-hArg1
ggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggagaagaaggcgaagaaggcgaagaaggtgaggagggtgaggagggaagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaag

SEQ ID NO: 247 - protein, 293 aa, Artificial Sequence
  amino acid sequence of GS100R9-GCSF
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 248 - DNA, 879 bp, Artificial Sequence
  nucleotide sequence of GS100R9-GCSF
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggaactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 249 - protein, 283 aa, Artificial Sequence
  amino acid sequence of GS100R35-GCSF
GPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 250 - DNA, 849 bp, Artificial Sequence
  nucleotide sequence of GS100R35-GCSF
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 251 - protein, 283 aa, Artificial Sequence
  amino acid sequence of GS100R52-GCSF
GPAGAPGEAGPPGPAGAEGEAGPAGAPGPPGEAGAPGPEGAEGEAGEPGPAGEPGEPGPEGPPGEAGAPGPPGAPGAEGEPGPEGAPGPPGPAGEPGPAGAPGPPGEAGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 252 - DNA, 849 bp, Artificial Sequence
  nucleotide sequence of GS100R52-GCSF
ggtccagctggtgctccaggtgaagctggtccaccaggtccagctggtgctgaaggtgaagctggtccagctggtgctccaggtccaccaggtgaagctggtgctccaggtccagaaggtgctgaaggtgaagctggtgaaccaggtccagctggtgaaccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 253 - protein, 283 aa, Artificial Sequence
  amino acid sequence of GS100R74-GCSF
GPEGAPGPPGPAGEPGPAGAPGPPGEAGEPGPEGPPGEAGAPGPPGAPGAEGEPGPEGAPGPPGPAGEPGPAGAPGPPGEAGPPGEAGAPGPEGAEGEAGEPGPAGEPGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 254 - DNA, 849 bp, Artificial Sequence
  nucleotide sequence of GS100R74-GCSF
ggtccagaaggtgctccaggtccaccaggtccagctggtgaaccaggtccagctggtgctccaggtccaccaggtgaagctggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 255 - protein, 283 aa, Artificial Sequence
  amino acid sequence of GS100R77-GCSF
GPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 256 - DNA, 849 bp, Artificial Sequence
  nucleotide sequence of GS100R77-GCSF
ggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtccagctggtactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 257 - protein, 283 aa, Artificial Sequence
  amino acid sequence of GS100R98-GCSF
GPAGEPGPAGAPGPPGEAGPAGAPGEAGPPGPAGAEGEAGPAGAPGEPGPEGPPGPEGAEGEAGEPGPAGEPGPEGAPGPPGEAGAPGPPGAPGAEGEPGAPGEPGPAGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 258 - DNA, 849 bp, Artificial Sequence
  nucleotide sequence of GS100R98-GCSF
ggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 259 - protein, 283 aa, Artificial Sequence
  amino acid sequence of GS100R112-GCSF
GPPGPAGAEGEAGPAGAPGEPGPEGPPGPEGAEGEAGEPGPAGEPGPEGAPGPPGEAGAPGPPGAPGAEGEPGAPGEPGPAGPAGEPGPAGAPGPPGEAGPAGAPGEAGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 260 - DNA, 849 bp, Artificial Sequence
  nucleotide sequence of GS100R112-GCSF
ggtccaccaggtccagctggtgctgaaggtgaagctggtccagctggtgctccaggtgaaccaggtccagaaggtccaccaggtccagaaggtgctgaaggtgaagctggtgaaccaggtccagctggtgaaccaggtccagaaggtgctccaggtccaccaggtgaagctggtgctccaggtccaccaggtgctccaggtgctgaaggtgaaccaggtgctccaggtgaaccaggtccagctggtccagctggtgaaccaggtccagctggtgctccaggtccaccaggtgaagctggtccagctggtgctccaggtgaagctggtactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 261 - protein, 614 aa, Artificial Sequence
  amino acid sequence of rGLK1164-GCSF
GPPGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGEQGKPGNQGEPGNPGSPGQPGNPGQPGSPGNPGQPGNEGPQGSQGNPGQPGEPGSNGQPGQPGQNGKNGQPGSPGSQGSPGNQGSPGNQGQPGNKGEQGKPGNQGPAGGSGGTPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 262 - DNA, 1842 bp, Artificial Sequence
  nucleotide sequence of rGLK1164-GCSF
ggtccacccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtgaacaaggtaaaccaggaaaccagggtgagccaggtaacccaggttcccctggtcagccaggtaaccctggtcaaccaggttctccaggtaatccaggtcaaccaggaaacgaaggtccacaaggttctcagggtaaccctggacaacctggtgagccaggttccaacggtcaacctggtcaacctggtcagaacggaaagaatggtcaacctggatccccaggttcacaaggctctccaggtaaccaaggatctcctggtaaccaaggacagcccggtaacaagggtgaacaaggtaaaccaggaaaccagggtccagccggtggctctggtggaactccattgggtccagcttcttctttgccacaatcttttttgttgaagtgtttggaacaagttagaaagattcaaggtgatggtgctgctttgcaagaaaagttgtgtgctacttacaagttgtgtcatccagaagaattggttttgttgggtcattctttgggtattccatgggctccattgtcttcttgtccatctcaagctttgcaattggctggttgtttgtctcaattgcattctggtttgtttttgtaccaaggtttgttgcaagctttggaaggtatttctccagaattgggtccaactttggatactttgcaattggatgttgctgattttgctactactatttggcaacaaatggaagaattgggtatggctccagctttgcaaccaactcaaggtgctatgccagcttttgcttctgcttttcaaagaagagctggtggtgttttggttgcttctcatttgcaatcttttttggaagtttcttacagagttttgagacatttggctcaacca

SEQ ID NO: 263 - protein, 1225 aa, Artificial Sequence
  amino acid sequence of GS800R9-GH-GS100R9
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 264 - DNA, 3675 bp, Artificial Sequence
  nucleotide sequence of GS800R9-GH-GS100R9
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggattcccaactattccattgtctagattgttcgacaacgctatgttgagagcccacagattgcaccaattggctttcgacacttaccaagaattcgaagaagcttacattccaaaggaacagaagtactctttcttgcaaaacccacaaacttctttgtgtttctctgaatctattccaactccatctaacagagaagaaactcaacaaaagtctaacttggaattgttgagaatttctttgttgttgattcaatcttggttggaaccagttcaattcttgagatctgttttcgctaactctttggtttacggtgcttctgactctaacgtttacgacttgttgaaggacttggaagaaggtattcaaactttgatgggtagattggaagacggttctcctagaactggtcaaattttcaagcaaacttactctaagttcgacactaactctcacaacgacgacgctttgttgaagaactacggtttgttgtactgtttcagaaaggacatggacaaggttgaaactttcttgagaattgttcaatgtagatctgttgaaggttcttgtggtttcggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 265 - protein, 1164 aa, Artificial Sequence
  amino acid sequence of GS800R35-GH-GS100R35
GPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEAGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGPPGEAGAPGPEGAEGEAGEPGPAGEPGPAGAPGEAGPPGPAGAEGEAGPAGAPGEPGPEGPPGEAGAPGPPGAPGAEGEPGPEGAPGPPGPAGEPGPAGAPGPPGEA

SEQ ID NO: 266 - DNA, 3492 bp, Artificial Sequence
  nucleotide sequence of GS800R35-GH-GS100R35
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtttcccaactattccattgtctagattgttcgacaacgctatgttgagagcccacagattgcaccaattggctttcgacacttaccaagaattcgaagaagcttacattccaaaggaacagaagtactctttcttgcaaaacccacaaacttctttgtgtttctctgaatctattccaactccatctaacagagaagaaactcaacaaaagtctaacttggaattgttgagaatttctttgttgttgattcaatcttggttggaaccagttcaattcttgagatctgttttcgctaactctttggtttacggtgcttctgactctaacgtttacgacttgttgaaggacttggaagaaggtattcaaactttgatgggtagattggaagacggttctcctagaactggtcaaattttcaagcaaacttactctaagttcgacactaactctcacaacgacgacgctttgttgaagaactacggtttgttgtactgtttcagaaaggacatggacaaggttgaaactttcttgagaattgttcaatgtagatctgttgaaggttcttgtggtttcggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 267 - protein, 1164 aa, Artificial Sequence
  amino acid sequence of GS800R127-GH-GS100R127
GPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEAGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGPPGPAGAEGEAGPAGAPGEPGPEGPPGPEGAPGPPGPAGEPGPAGAPGPPGEAGEPGPEGPPGEAGAPGPPGAPGAEGEPGPEGAPGPPGPAGEPGPAGAPGPPGEA

SEQ ID NO: 268 - DNA, 3492 bp, Artificial Sequence
  nucleotide sequence of GS800R127-GH-GS100R127
ggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagctggttttccaactattccattgtctagattgtttgataacgctatgttgagagctcatagattgcatcaattggcttttgatacttaccaagaatttgaagaagcttacattccaaaggaacaaaagtactcttttttgcaaaacccacaaacttctttgtgtttttctgaatctattccaactccatctaacagagaagaaactcaacaaaagtctaacttggaattgttgagaatttctttgttgttgattcaatcttggttggaaccagttcaatttttgagatctgtttttgctaactctttggtttacggtgcttctgattctaacgtttacgatttgttgaaggatttggaagaaggtattcaaactttgatgggtagattggaagatggttctccaagaactggtcaaatttttaagcaaacttactctaagtttgatactaactctcataacgatgatgctttgttgaagaactacggtttgttgtactgttttagaaaggatatggataaggttgaaacttttttgagaattgttcaatgtagatctgttgaaggttcttgtggttttggtccaccaggtgaagctggtgctccaggtccagaaggtgctgaaggtgaagctggtgaaccaggtccagctggtgaaccaggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtccagaaggtgctccaggtccaccaggtccagctggtgaaccaggtccagctggtgctccaggtccaccaggtgaagct

SEQ ID NO: 269 - protein, 1164 aa, Artificial Sequence
  amino acid sequence of GS800L91-GH-GS100L91
GAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEP

SEQ ID NO: 270 - DNA, 3492 bp, Artificial Sequence
  nucleotide sequence of GS800L91-GH-GS100L91
ggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaaccaggttttccaactattccattgtctagattgtttgataacgctatgttgagagctcatagattgcatcaattggcttttgatacttaccaagaatttgaagaagcttacattccaaaggaacaaaagtactcttttttgcaaaacccacaaacttctttgtgtttttctgaatctattccaactccatctaacagagaagaaactcaacaaaagtctaacttggaattgttgagaatttctttgttgttgattcaatcttggttggaaccagttcaatttttgagatctgtttttgctaactctttggtttacggtgcttctgattctaacgtttacgatttgttgaaggatttggaagaaggtattcaaactttgatgggtagattggaagatggttctccaagaactggtcaaatttttaagcaaacttactctaagtttgatactaactctcataacgatgatgctttgttgaagaactacggtttgttgtactgttttagaaaggatatggataaggttgaaacttttttgagaattgttcaatgtagatctgttgaaggttcttgtggttttggtgctccaggtccagaaggtgctgaaggtgaagctggtgaaccaggtccagctggtgaaccaggtccagaaggtgctccaggtccaccaggtccagctggtgaaccaggtccagctggtgctccaggtccaccaggtgaagctggtccagctggtgctccaggtgaagctggtccaccaggtccagctggtgctgaaggtgaagctggtccagctggtgctccaggtgaaccaggtccagaaggtccaccaggtgaagctggtgctccaggtccaccaggtgctccaggtgctgaaggtgaaccaggtgctccaggtgaacca

SEQ ID NO: 271 - protein, 1164 aa, Artificial Sequence
  amino acid sequence of GS800L102-GH-GS100L102
GEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPAGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGEPGPEGAAGEEGPEGAEGPAGPAGAPGAPGAEGEEGPPGEAGEPGAPGPEGAAGPPGAEGEAGEAGEAGPAGEEGPPGAPGPPGEAGEEGAPGAEGEAGPPGAEGPA

SEQ ID NO: 272 - DNA, 3492 bp, Artificial Sequence
  nucleotide sequence of GS800L102-GH-GS100L102
ggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagctggttttccaactattccattgtctagattgtttgataacgctatgttgagagctcatagattgcatcaattggcttttgatacttaccaagaatttgaagaagcttacattccaaaggaacaaaagtactcttttttgcaaaacccacaaacttctttgtgtttttctgaatctattccaactccatctaacagagaagaaactcaacaaaagtctaacttggaattgttgagaatttctttgttgttgattcaatcttggttggaaccagttcaatttttgagatctgtttttgctaactctttggtttacggtgcttctgattctaacgtttacgatttgttgaaggatttggaagaaggtattcaaactttgatgggtagattggaagatggttctccaagaactggtcaaatttttaagcaaacttactctaagtttgatactaactctcataacgatgatgctttgttgaagaactacggtttgttgtactgttttagaaaggatatggataaggttgaaacttttttgagaattgttcaatgtagatctgttgaaggttcttgtggttttggtgaaccaggtccagaaggtgctgctggtgaagaaggtccagaaggtgctgaaggtccagctggtccagctggtgctccaggtgctccaggtgctgaaggtgaagaaggtccaccaggtgaagctggtgaaccaggtgctccaggtccagaaggtgctgctggtccaccaggtgctgaaggtgaagctggtgaagctggtgaagctggtccagctggtgaagaaggtccaccaggtgctccaggtccaccaggtgaagctggtgaagaaggtgctccaggtgctgaaggtgaagctggtccaccaggtgctgaaggtccagct

SEQ ID NO: 273 - protein, 1164 aa, Artificial Sequence
  amino acid sequence of GS800L146-GH-GS100L146
GAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPEGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGAEGPPGPEGAEGPAGPPGEEGAAGAEGEEGEPGAEGPAGPAGEAGAEGAPGPPGEAGAPGEAGPAGPPGEEGPEGAPGAEGPPGAAGEEGPAGAPGEPGAAGEEGPE

SEQ ID NO: 274 - DNA, 3492 bp, Artificial Sequence
  nucleotide sequence of GS800L146-GH-GS100L146
ggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaaggttttccaactattccattgtctagattgtttgataacgctatgttgagagctcatagattgcatcaattggcttttgatacttaccaagaatttgaagaagcttacattccaaaggaacaaaagtactcttttttgcaaaacccacaaacttctttgtgtttttctgaatctattccaactccatctaacagagaagaaactcaacaaaagtctaacttggaattgttgagaatttctttgttgttgattcaatcttggttggaaccagttcaatttttgagatctgtttttgctaactctttggtttacggtgcttctgattctaacgtttacgatttgttgaaggatttggaagaaggtattcaaactttgatgggtagattggaagatggttctccaagaactggtcaaatttttaagcaaacttactctaagtttgatactaactctcataacgatgatgctttgttgaagaactacggtttgttgtactgttttagaaaggatatggataaggttgaaacttttttgagaattgttcaatgtagatctgttgaaggttcttgtggttttggtgctgaaggtccaccaggtccagaaggtgctgaaggtccagctggtccaccaggtgaagaaggtgctgctggtgctgaaggtgaagaaggtgaaccaggtgctgaaggtccagctggtccagctggtgaagctggtgctgaaggtgctccaggtccaccaggtgaagctggtgctccaggtgaagctggtccagctggtccaccaggtgaagaaggtccagaaggtgctccaggtgctgaaggtccaccaggtgctgctggtgaagaaggtccagctggtgctccaggtgaaccaggtgctgctggtgaagaaggtccagaa

SEQ ID NO: 275 - protein, 1225 aa, Artificial Sequence
  amino acid sequence of GS800S203-GH-GS100S203
GPPGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGPPGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPA

SEQ ID NO: 276 - DNA, 3675 bp, Artificial Sequence
  nucleotide sequence of GS800S203-GH-GS100S203
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtggattcccaactattccattgtctagattgttcgacaacgctatgttgagagcccacagattgcaccaattggctttcgacacttaccaagaattcgaagaagcttacattccaaaggaacagaagtactctttcttgcaaaacccacaaacttctttgtgtttctctgaatctattccaactccatctaacagagaagaaactcaacaaaagtctaacttggaattgttgagaatttctttgttgttgattcaatcttggttggaaccagttcaattcttgagatctgttttcgctaactctttggtttacggtgcttctgactctaacgtttacgacttgttgaaggacttggaagaaggtattcaaactttgatgggtagattggaagacggttctcctagaactggtcaaattttcaagcaaacttactctaagttcgacactaactctcacaacgacgacgctttgttgaagaactacggtttgttgtactgtttcagaaaggacatggacaaggttgaaactttcttgagaattgttcaatgtagatctgttgaaggttcttgtggtttcggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagct

SEQ ID NO: 277 - protein, 345 aa, Artificial Sequence
  amino acid sequence of GS200R9-GDF15
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 278 - DNA, 1035 bp, Artificial Sequence
  nucleotide sequence of GS200R9-GDF15
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggagctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 279 - protein, 329 aa, Artificial Sequence
  amino acid sequence of GS200L23-GDF15
GAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 280 - DNA, 987 bp, Artificial Sequence
  nucleotide sequence of GS200L23-GDF15
ggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 281 - protein, 329 aa, Artificial Sequence
  amino acid sequence of GS200L136-GDF15
GEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 282 - DNA, 987 bp, Artificial Sequence
  nucleotide sequence of GS200L136-GDF15
ggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 283 - protein, 345 aa, Artificial Sequence
  amino acid sequence of GS200S14-GDF15
GPPGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 284 - DNA, 1035 bp, Artificial Sequence
  nucleotide sequence of GS200S14-GDF15
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtggagctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 285 - protein, 573 aa, Artificial Sequence
  amino acid sequence of GS400R9-GDF15
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 286 - DNA, 1719 bp, Artificial Sequence
  nucleotide sequence of GS400R9-GDF15
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggagctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 287 - protein, 545 aa, Artificial Sequence
  amino acid sequence of GS400L23-GDF15
GAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 288 - DNA, 1635 bp, Artificial Sequence
  nucleotide sequence of GS400L23-GDF15
ggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 289 - protein, 545 aa, Artificial Sequence
  amino acid sequence of GS400L136-GDF15
GEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 290 - DNA, 1635 bp, Artificial Sequence
  nucleotide sequence of GS400L136-GDF15
ggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 291 - protein, 573 aa, Artificial Sequence
  amino acid sequence of GS400S14-GDF15
GPPGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 292 - DNA, 1719 bp, Artificial Sequence
  nucleotide sequence of GS400S14-GDF15
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtggagctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 293 - protein, 801 aa, Artificial Sequence
  amino acid sequence of GS600R9-GDF15
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 294 - DNA, 2403 bp, Artificial Sequence
  nucleotide sequence of GS600R9-GDF15
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggagctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 295 - protein, 761 aa, Artificial Sequence
  amino acid sequence of GS600L23-GDF15
GAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 296 - DNA, 2283 bp, Artificial Sequence
  nucleotide sequence of GS600L23-GDF15
ggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtgctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 297 - protein, 761 aa, Artificial Sequence
  amino acid sequence of GS600L136-GDF15
GEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGEAGPPGEAGEAGAPGPEGAAGEPGPEGEEGEAGAPGEEGPPGEAGPAGPPGAAGPAGAEGEEGEPGEPGPAGAEGPPGAAGPAGPEGPEGAAGAEGEEGEAGPPGPAGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 298 - DNA, 2283 bp, Artificial Sequence
  nucleotide sequence of GS600L136-GDF15
ggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgaagctggtccaccaggtgaagctggtgaagctggtgctccaggtccagaaggtgctgctggtgaaccaggtccagaaggtgaagaaggtgaagctggtgctccaggtgaagaaggtccaccaggtgaagctggtccagctggtccaccaggtgctgctggtccagctggtgctgaaggtgaagaaggtgaaccaggtgaaccaggtccagctggtgctgaaggtccaccaggtgctgctggtccagctggtccagaaggtccagaaggtgctgctggtgctgaaggtgaagaaggtgaagctggtccaccaggtccagctggtgctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 299 - protein, 801 aa, Artificial Sequence
  amino acid sequence of GS600S14-GDF15
GPPGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 300 - DNA, 2403 bp, Artificial Sequence
  nucleotide sequence of GS600S14-GDF15
ggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtggagctagaaacggtgatcattgtccattgggtccaggtagatgttgtagattgcatactgttagagcttctttggaagatttgggttgggctgattgggttttgtctccaagagaagttcaagttactatgtgtattggtgcttgtccatctcaatttagagctgctaacatgcatgctcaaattaagacttctttgcatagattgaagccagatactgttccagctccatgttgtgttccagcttcttacaacccaatggttttgattcaaaagactgatactggtgtttctttgcaaacttacgatgatttgttggctaaggattgtcattgtatt

SEQ ID NO: 301 - protein, 948 aa, Artificial Sequence
  amino acid sequence of GLP2G-GS800R9
HGDGSFSDEMNTILDNLAARDFINWLIQTKITDGPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPA

SEQ ID NO: 302 - DNA, 2844 bp, Artificial Sequence
  nucleotide sequence of GLP2G-GS800R9
catggtgatggttctttttctgatgaaatgaacactattttggataacttggctgctagagattttattaactggttgattcaaactaagattactgatggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagct

SEQ ID NO: 303 - protein, 948 aa, Artificial Sequence
  amino acid sequence of GLP2G-GS800S14
HGDGSFSDEMNTILDNLAARDFINWLIQTKITDGPPGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGEAGEPGPPGPAGAPGPAGEPGEAGPPGAPGPAGPPGPA

SEQ ID NO: 304 - DNA, 2844 bp, Artificial Sequence
  nucleotide sequence of GLP2G-GS800S14
catggtgatggttctttttctgatgaaatgaacactattttggataacttggctgctagagattttattaactggttgattcaaactaagattactgatggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtgaagctggtgaaccaggtccaccaggtccagctggtgctccaggtccagctggtgaaccaggtgaagctggtccaccaggtgctccaggtccagctggtccaccaggtccagct

SEQ ID NO: 305 - protein, 948 aa, Artificial Sequence
  amino acid sequence of GLP2G-GS800S203
HGDGSFSDEMNTILDNLAARDFINWLIQTKITDGPPGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPAGAPGEPGPAGPPGAEGAPGPAGPEGEAGAEGEPGEAGPPGAPGEAGAEGAPGPEGEPGEAGPEGAPGPAGEPGAPGPPGEPGPAGEAGEPGAPGPAGEAGPPGAPGPAGPPGPA

SEQ ID NO: 306 - DNA, 2844 bp, Artificial Sequence
  nucleotide sequence of GLP2G-GS800S203
catggtgatggttctttttctgatgaaatgaacactattttggataacttggctgctagagattttattaactggttgattcaaactaagattactgatggtccacctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagctggtgctccaggtgaaccaggtccagctggtccaccaggtgctgaaggtgctccaggtccagctggtccagaaggtgaagctggtgctgaaggtgaaccaggtgaagctggtccaccaggtgctccaggtgaagctggtgctgaaggtgctccaggtccagaaggtgaaccaggtgaagctggtccagaaggtgctccaggtccagctggtgaaccaggtgctccaggtccaccaggtgaaccaggtccagctggtgaagctggtgaaccaggtgctccaggtccagctggtgaagctggtccaccaggtgctccaggtccagctggtccaccaggtccagct

SEQ ID NO: 307 - protein, 815 aa, Artificial Sequence
  amino acid sequence of GS600R9-ARVEGF
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGGSDLDKKLLEAARAGQDDEVRILMANGADVNARDSTGWTPLHLAAPWGHPEIVEVLLKNGADVNAADFQGWTPLHLAAAVGHLEIVEVLLKYGADVNAQDKFGKTAFDISIDNGNEDLAEILQKAA

SEQ ID NO: 308 - DNA, 2445 bp, Artificial Sequence
  nucleotide sequence of GS600R9-ARVEGF
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggaggttctgatttggataagaagttgttggaagctgctagagctggtcaagatgatgaagttagaattttgatggctaacggtgctgatgttaacgctagagattctactggttggactccattgcatttggctgctccatggggtcatccagaaattgttgaagttttgttgaagaacggtgctgatgttaacgctgctgattttcaaggttggactccattgcatttggctgctgctgttggtcatttggaaattgttgaagttttgttgaagtacggtgctgatgttaacgctcaagataagtttggtaagactgcttttgatatttctattgataacggtaacgaagatttggctgaaattttgcaaaaggctgct

SEQ ID NO: 309 - protein, 1157 aa, Artificial Sequence
  amino acid sequence of GS900R9-ARVEGF
GPPGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGEAGAPGPEGAEGEAGEPGPAGEPGPEGAPGPPGPAGEPGPAGAPGPPGEAGPAGAPGEAGPPGPAGAEGEAGPAGAPGEPGPEGPPGEAGAPGPPGAPGAEGEPGAPGEPGPAGGGSDLDKKLLEAARAGQDDEVRILMANGADVNARDSTGWTPLHLAAPWGHPEIVEVLLKNGADVNAADFQGWTPLHLAAAVGHLEIVEVLLKYGADVNAQDKFGKTAFDISIDNGNEDLAEILQKAA

SEQ ID NO: 310 - DNA, 3471 bp, Artificial Sequence
  nucleotide sequence of GS900R9-ARVEGF
ggtccacctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtgaagctggtgcacccggacccgaaggtgccgaaggagaggctggtgaacctggacccgccggtgaaccaggacctgaaggagctccaggtcctcctggacccgcaggagagcccggtcctgccggtgctcctggtccacccggagaagcaggtccagccggagctcctggtgaggctggtcccccaggacccgctggagctgaaggtgaggcaggtccagccggcgctccaggtgagccaggaccagaaggtccaccaggagaagctggagcacccggtcctccaggagcacccggcgctgaaggagaacccggtgctcctggagaacccggtccagctggtggaggttctgatttggataagaagttgttggaagctgctagagctggtcaagatgatgaagttagaattttgatggctaacggtgctgatgttaacgctagagattctactggttggactccattgcatttggctgctccatggggtcatccagaaattgttgaagttttgttgaagaacggtgctgatgttaacgctgctgattttcaaggttggactccattgcatttggctgctgctgttggtcatttggaaattgttgaagttttgttgaagtacggtgctgatgttaacgctcaagataagtttggtaagactgcttttgatatttctattgataacggtaacgaagatttggctgaaattttgcaaaaggctgct

I claim:

1. A gelatin-like protein, wherein a core structure of the gelatin-like protein is $U_1$-$U_2$ or $U_1$-$U_2$- . . . $U_a$; wherein $U_1$, $U_2$, . . . , $U_a$ are gelatin-like protein units, each of the gelatin-like protein units has an amino acid sequence selected from a group consisting of SEQ ID NO: 25, 27, 29, and 31; wherein a is an integer greater than or equal to 3; and the gelatin-like units are the same or different.

2. The gelatin-like protein according to claim 1, wherein a total number of amino acid residues in the core structure accounts for at least 70%, 80%, 85%, 90%, 95%, or 99% of the total number of amino acid residues in the gelatin-like protein.

3. The gelatin-like protein according to claim 1, wherein
   a content of alanine in the gelatin-like protein is greater than or equal to 10%; and/or,
   in the gelatin-like protein, a GRAVY (Grand average of hydropathy) value representing hydrophilicity is greater than −1.1.

4. The gelatin-like protein according to claim 3, wherein the content of alanine in the gelatin-like protein is within a range of 10-45%; and/or,
   in the gelatin-like protein, a GRAVY value representing hydrophilicity is less than or equal to 0.

5. The gelatin-like protein according to claim 1, wherein the gelatin-like protein comprises 100-2000 amino acids.

6. The gelatin-like protein according to claim 1, wherein
   the gel strength of the gelatin-like protein is less than or equal to 10 g; and/or,
   the viscosity of the gelatin-like protein is less than or equal to 3 mPa·s.

7. The gelatin-like protein according to claim 1, wherein the gelatin-like protein has:
   (1) an amino acid sequence selected from a group consisting of SEQ ID NO: 91, 93, and 95; or
   (2) an amino acid sequence including two or more of the amino acid sequences described in (1).

8. A fusion protein, wherein the fusion protein comprises the gelatin-like protein according to claim 1 and a bioactive protein.

9. The fusion protein according to claim 8, wherein the bioactive protein is an enzyme, an enzyme inhibitor, an antigen, an antibody, a hormone, a coagulation factor, an interferon, a cytokine, a growth factor, a differentiation factor, a factor related to bone tissue growth, a factor related to bone factor absorption, a chemotactic factor, a cell motility factor, a migration factor, a cytostatic factor, an antifungal factor, a plasma adhesion molecule, an interstitial adhesion molecule, an extracellular matrix protein, a receptor ligand, or fragments thereof.

10. The fusion protein according to claim 8, wherein an amino acid sequence of the fusion protein is selected from amino acid sequences having an identity percentage of at least 80% with any amino acid sequence shown in any odd-numbered sequence in SEQ ID NOs: 211-239, 247-259 and 263-309.

11. A polynucleotide sequence, wherein the polynucleotide sequence is selected from:
   i. a polynucleotide sequence encoding the gelatin-like protein according to claim 1, or a fusion protein; wherein,
      the fusion protein comprises the gelatin-like protein and a bioactive protein; and
   ii. a complementary sequence of the polynucleotide sequence described in i.

12. A nucleic acid construct, wherein the nucleic acid construct comprises the polynucleotide sequence according to claim 11.

13. A host cell, wherein the host cell comprises the polynucleotide sequence according to claim 11, and/or a nucleic acid construct, wherein the nucleic acid construct comprises the polynucleotide sequence according to claim 11.

14. A host cell, wherein the host cell expresses the gelatin-like protein according to claim 1, and/or a fusion protein, wherein
   the fusion protein comprises the gelatin-like protein and a bioactive protein.

\* \* \* \* \*